United States Patent 12,642,819 (COMPOSITIONS AND METHODS FOR TREATING INFLAMMATORY BOWEL DISEASE) - sequence listing, part 108

SEQ ID NO: 57 - DNA, 2205752 bp, Weissella sp.
gaacacagaagttaagctcagtaacgccgaaagtagttggaggatcgcttcctgcgaggataggaagtcgcgatgcacatggacgtttagctcagctgggagagcacctgccttacaagcagggggtcacaggttcgatccctgtaacgtccattgggtcgttagctcagttggtagagcagtggacttttaatccatgggtccagggttcgagcccctgacgacccatttgggtgacatctaaatattccgttatccggtgaattattattacgccgacttagctcagttggtagagcatcgctcttgtaaagcgagggtcgaaggttcgagtcctttagtcggcatcatgcgaatatagttcagttggtagaacgctaccttgccatggtagaggtcgcgggttcgaatcccgttgttcgcttttgccggcttggcggaataggcagacgcacaggacttaaaatcctgcgatggaaacatcgtaccggttcgatcccggtagccggcacttattaatggacttatatgctaattggataaacaccccggctacgaaccgggtattgcaggttcgagtcctgctaggtccattaacaaacgaaagtttgttattatagtttaatcgtttcgggacgtagctcagcttggtagagcacctggtttgggaccagggggtcgcaggttcgaatcctgtcgtcccgatttataacagaatatgttatagttcgcggtgtagctcagctggctagagcgtccggttcatacccgggaggtcgagggttcgattccccccgccgcgattgactcaaataacaaggacctttagctcagttggttagagcagacggctcataaccgtccggtcgttggttcgagtccaacaaggtccatcatagaccttaagtctttatggagaattacccaagtctggctgaagggaacggtcttgaaaaccgtcaggtcgtgaaagcggcgcgtgggttcgaatcccacattctcctttgatgttaagtcatcattattatttattatcgcgggatggagcagtctggtagctcgtcgggcccataacccgaaggtcgtaggttcaaatcctgctcccgcaattgattaacttagttaatcactaaaacagaaatgtttggtcgcatggtctagttggttaggacgttcgcctgtcacgcgaaagatcacgggttcgaatcccgttgtgaccgttataatggctcggtagctcagttggtagagcatacgattgaagctcgtagtgtcgggggttcgattccctcccgcgccattgctcggaagagcaaattgaaatattttgcggatgtagtacaatggctagtgctccagccttccaagctgggaatgcgggttcgattcccgtcgtccgcttttttgttttatgggactgtagctcagctggttagagcgcacccctgataagggtgaggtcggaggttcgagtcctctcagtcccatggttgaaaggttcaacttttgacatggggacatactcaagaggctgaagaggcgcccctgctaagggtgtaggtcgggaaactggcgcgagggttcgaatccctctgtctccgctactgatggtagatgcttatctaccattttttatttgcaataaagaataatcattaggtgttatctgcttgtcaggtaacaccttttttgtttatcgcagtatctatcgggcttgccatgcaacggatgaatcagatgttaaaaaatgcaatttctgcataaacagtaattttcaatcatcggactgattgattgaataggttgaaaacggtaataaacgggtgattagtgttgttcactagcgacaaataagacacattgaaaatatgttcggctgttgaatgttaatagagtgagcttgttagtattttgataaccgcttatgctgaatgtatcttatgtaagcaaggggaatagattatgaagttagtatcggggagcttgaagcgtcgtcgtgagcagttggggatctcacaagctgaggttgcagaaggtatttgtcatcaatcactgttgtctcgtatcgaacgcacagatgaagtttctaatatgacggtgctacaaaagttgtgtgaacgtctacaactgaacgcggctgacatcgcacgtattaatgaaaaggcgttaacaccgttaagcgttgtacgtcgcctaattgaaaagaatcaaattgaagaggcagaagaggcattgttaaatccagcgttaacaacgcgcattccaatctatgcgattccagagtttaatgtgctacgcgcgcgggtagctttgtaccatagccaggctgctgaggcgatgcaattattacaagttgcattgggcgatgtagataagtaccaggtcgagctgacaatcgaaatttttacagaaatgggtgcaacgtggacggcacaagataaaaatgagttagctgcagaatgctttgagcgagcttgtggcttaattcgtcagtcttcagttgatacgcaggctgcaatggcgtcagttattacacatacatatcgccatcaagcagaaatgtacttggcaagtggctttgctgacaaagcaatggaacgggtcgtggaagcattagaaatgttaccaactaccactgattatcatgaaatggtcgcgctacaaacgattcgaatgaagtgtgcagatgcgctcgctttgtctactgaaaagaaagaagcacagttactggcctatgctgcggctgaattttcaaaggacgtcaccctaaaagaggatgttaaagcatacagcatgttagcgtaacataaaagacgctacagcatcgtgtagcgtcttttatagttagtaacctcgtgtgacatcgacgaagttagttgttaatggtttgcccgctaaaaagtcaggcaaatttttcataaataatgggaacagattaccagctcgacctgatgattcatgttctgcccaggttgtgtgttgcgtcagtagcaaattgtcatgatgccagagtggcgaatcgtcgggaattggttcgatttccgtcacatccaacgctgcgtagcgaatagattgcgtagctaaggcatcaagcaaggctgtttgatcaacagtagaaccacgaccgacattcacgaacaagaagagattctggaattgtgctagcatttcagcgttaaagaaatgcttggtggcatcggtacctggcaggacgctgatgacgacagcaacctctggtagggatgacaagtcgttgatgctaaacgtggcgtcaaagccttctacgggacgtccagaagtattcacgccatatacaggtgtgttaaagactgataggtagcgagcaatttgctgaccaatgtgtcctgtaccaaaaatgacggttggcaattctgagagcatgtattggtcagtgaactcttcccagtgattgcgggtttgatagacgttcaaaccacgtgcaaagtgcatcatgtagccaatagctgattgggcaattggcacagactttaacccactggcatttgttaatagaataccttgttcagccagttcttttaagggcatatagtccacaccagcggacattgtttgaatccactttaattgattattaggcattgataggatttttggtcccaaggtggctgaccacccatagctaatggtgacgttggccaaagcatcgtcgctaatgacgtctggcgtcgtaacagtaacgccgagttcattcagttgtgtgatatcagcatcacgcaagggttgaacggcgagtagtagttgagacatagtctagccctcctatggttatttacgtttagtgtatgacaaatcattagtatcgtctattaatatacacgcaatacctttttggcgcactaaaagttagtgccttgttataataacctcacagaaacagaagaggatattattatgatgaattcacaaaacaagacgcgtcgtttggtgcttacagctttgtttattgcaattattttggttcaatcaatcgtcccttggctaggggtgttgtctatcacaccagcggctggtgtcggtgtacaagttcaaattattagtgtaacagtggccattggtgccatgatccttggaccacgtgttggtgcattgcttggattcgtatggggtgcatattcactttggatggcatggtcaaacgtaccaagcattggtggcatgattttccgtaacccaattacagcattgctacctcgtattttggtaggactaatcgttggattgatttactggtatgttgtccgtaagcaatcacttgcccgccaaacgggttggattgtcttcttaggaggtttgtcagctttcttgaacaccttctttgtattgctatcaacgtggattggcttctcagtgatgcacacaacgttcacgggtattccaacatcaggattggcaaactggttgatcttcggtgtcgctggtgtcaatgggctggttgaaattgttgtatcagcaatcttggtgccattgattggtatgccagtattgactgtattgaagcgcttaaattaacaattagtacgaaaaactggaactggcattttgccggttccagtttttttgttgatactatgaataaagtattaaggcctaatatatcagtagcataaaccggactataattgtacaatgaaagagtaagtgagcacttattaagagcttgggagagcaaataaattttgggatagtaggaggcaagttttatgaacttgatcgaaggactttccattttggacctggctcgaattcagttcgcaatgacaacgatttttcactttttcttcgtgccattgtcaattggtttgggactagttgtcgccatcatggaaacgatgtatgtggtcaaaaaagatgatcaatacaagcgtatggcaaagttctggggaaagattttcctattaagctttgcggtcggagttgtcacgggtattattcaagagttccaatttggaatgaactggtcccgttactcacgttatgttggagacatctttgggccggctttggctgttgaggcgttggttgcgttctttatggaatcaacgttcttgggtctttggatgtttggttgggaacgattcaacaagaaactacacttggtcttcatttggttgacgacactaggatcagctttttcagctttgtggattctagcagccaactcatttatgcaaaacccggttggcttcaaggttgatcacaagtttgaccgtgcggttttggtcgactttccagcattgctacagaatcaccaattatggttggaattcccgcacgttatctttgggacgttcctaacgggatcattcgtggtcattggtgtgtcagcttggtcattgttgcgtaagccaaacagtaaccttgatttctttaagaagtcaatcaaggttgccgcagtggtggcattgattggtacagcaggaattggtttgacgggtgatcgtcattcactttacttgcaagaagatcaaccaatgaagttcgcagcaactgaaggattggatgaaaatgtcggtggtaaggataagcaagagccttggtcggtagttgcttacacaaacccaaagacacacgaagttgaatggtcattggacattccgtacgtgttgtctatcttggctcaccactcattgactggtgaaaacaagggttggacagagattaacaagaaattgcatgaaaagtacgatgtgaagtttgggcatgatatgaactactacttgccaaacaacaccatttactacgcattccgtgtgatggctgtatcagctggtgcatttggtttgttagctgttgtggcattgtgggcggttcgtaagaagtcaaagctagatattacgaagtatcgctgggcactttggattttcggactatcaatgttcctaccatttttggcacaaacagcgggttggttgattaccgagctcggtcgtgcaccatgggttgtttatggtgtgctaacgattgcggatgcggtgtcaccaaatgtgtcatttgcgtcattgctaacgtctaacattttgtacttcgcaacgttcgctgcgctaggtggtttgatgttcatgttggcgcgtcgtgtcatgattgcaggtccagatagcgttgatgataagccagaagctcaggatgttgatccattctcagcagaagcatttgatgcaggaaaggaggcttaatcatgacaggatttcaaattctatggttcgtattgattgccatcttgtttgcaggatttttcttcctagaaggattcgacttcggagttggaatggccttgaagggcttagctaagaatgaacatgaagaagatgccctaatcgaatcaatcggccctcactgggatggtaacgaagtgtggttgattacggctggtggtgccatgttcgcggccatgccattctggtatgcctcactattttcagggttctatttaatcctattcgcgattctgattggtttgatttaccgaggcgtatcattcgagttccgtgagcaaatgcgtacggcgaagttccgcaatttgtggacgacaatctcagcagtcgcagcgttgattgtgccattcctattcggtgtattattcacggacgttgtccaaggtatgcctttggataaggctggtgatatgtcagctacgttctttgactacttcaacattttctcaatcgttggtggtgttgccgttgcgttgttgtcatacatccacggattgaactacttacgtttgaagattgaagagggtgagctacatgatcgtatccaatcacaattgaaggtcttgtacccagtgttgttggttggtgaagttgctttcgcagtaacgttgttcattttcactgatttctttgctaagaagccccttattacattggcatttctagcagtcatcgtgttgttgacggtcatcgcttgggtaacaggcttgaagcgctcaaacgtatggtcatttattgctttgggactcacaattatttcagtcgtgttgttgctattcacggggttgttcccacgtgtcattgttggggataacccagccatgtcattgttgttgaagaatgcaacgtcaacgccatacacattgaagtggatgacgatgattgccttcacggctttgccaattgtgttggcctatcaaatttggagcttctacatcttccgcaagcgaattgttgtgaagaaggcagcttaacataaaacaaacagaggggatcaagtgtgtgcttggtcctctttatacatattagttagatggagagatggcggtatgctagataaaagattatttaaatttcctggtgcccgaaaagcgttgggaatcttgtcagtgctcactttgattcaggccttagccattattggtcaaggtcgcttcttgagcattacgattacagacttgtggcaaggacataaattaggtgcggtggtgacgccggttctgatttttgtggccgcttacctgatgcgtcaactaatgggggttgcaaagcagtacgccttgtcaccgtttgctgatgccacaacggcgtcactacaaacgcagttaacggaaaagtatgcagcactgggaccacgagttgtggctaatcaaggaactggtaagtcggttactttggcagtagaaggtattgatcaagtgcatgattatttgacattggtgttggtgaagttattcgatatgagtattattccttggttgattttggcgtatgttgccatgattaattgggaacaagccgtcttcctattctttatttatcctgttattgtgctgtttatgattgtgttggggatggctgcgcaggcaaaagctgatcgtgaatacgccactttcaaccgactttcaaatcactttgttgactctttacgtggtctaacgactttgaagcaactaggtttgtcaaaacaatatgcgaataacatttacgaagtgtcagaagaccaccgtaaggcaacgatgagtacattgaagattgccatcctgtcaacatttgcgctggatttctttacgacgctttcaatagcagttgtggcgctatttttgggactaggactaatggatggcacaatgacgctattacccgctttaacgattttggttttagcaccggaatacttcttgccaatccgtaattttgctaatgattaccacgcaacgttgaatggtaaaaatgcattggccgacattatggcgctgttggatcaaccgacagcgactgatacagatgagtatcaaacaacgagtcaacgttggcgcgaaaccgacgaattgcagttaactgacgtttcttatacttatccagaagcgaccgaaccggcattacatcacattaatctggactttaagggatatgaacgtgtggcgttggtcggaacatctggttcaggaaaatcaacattactgaatttgattggtggtttcttgaatggggctggcggtgtgtcattaaacggtcagcaattgcctcatctacaacagcgcgcttggcaggaacagattcaagttctaccgcaacaaccttatatttttcacgacacattgcgtcgcaacctggcattctatgcaccagaagcaacggacgaaaaaattcgtgaagcgattgaaacggttggtttgtcagagtggtttgaggcgctaccagaagggctggacacgctgattggtgaaggtgccatgcagacgtctggtggccaagctcagcgtattgggttggcacgtattatgcttgatgataatcggcgcgtcttgctgttggatgaaccaacggcccacttggatattgaaactgaagtacgactaaaggaaaccatgttacctttgttcgacaaacgtttggttgttttcgccacacaccgtttgcactggttaactgaaatggatttgattatcgtgatgcgtgatggacgaattgttgaacagggaaccttgtcagaactgatggctaataacggctactttgttgaattgcaagcggctatgcgaggtgtaacacatgcgtaaattactgaatttaattaaaaacgatacctgggttttcccatatttgaaatcgtataaaaagctactagtgttgattattttcttgggattcatgaccactttttctggggcagctttgatgttcacatcaggctttttgatttcccgttcagcacaaatgccagaaaatattttgatggtttacgtgccaatcgtattaacacgtgcatttggtattggtcgaccatcgttcaagtacgcacagcgcttagtatcacacaattgggtattacgaattgtctcaactttccgccgtcgtttgtatgagttagttgaaacaggaacgaagtctgtttatgcaaagtcgcaaaccggtgaagtcctgaatgtgttggcgaacgatttgttcaagattgaaaacttctatttgcgtacgttattcccaacaataattgggttagtcatttacgccctgattggcattggtgttggcgtgttcgattggggattcgccttagcgattttacttgtgttggcgatgacaacaattttggcgccgatggttacgttggcagtgaatggggcgcgagattttaagcaacaacaactagaaggtcaattgtatacggatttaacggatacggttatgggactacaagattgggtgttggctggtcgaacagcggaattggctgatcgccaacagcaagattttgcagcgataaatcgtattaaggtgcaacaagctcactttaattggtggcgtgattttggcggtgccatgattattggcgtggtcgcgattttattgatgatgtttgcgacatcacggtttggtggggatagtttcggcgtgaattggattgctgcctttgtgttggcaatttttccggctgaagatgcattaacaacaatcagttctggtgttggagaatggccacgttatcaagattcaatcgttcgattaaacgagatggacggagacgcgacgcaagaaaatcgcgagaccgttacacaacaaccagctcccaatcagtctgatatcatgtttgaccgagtatcatttggatatacaaatgacccggtcttgcaagatttatcattgcaggtgccggccggtgaacgattggccatattgggacagtctggggctgggaaaacaacattgctaaagttgttgctgggtgatgaaaacccaacagctggtacaattacaattggtggtgtaccagtcgctgccttagctgaaactcgtgcatccattatttctgtgttggatcaacaaccatacttatttgcaagcacggttgcgaacaatttacgtctgggtaatttgcatgcttctgacgagcagttgtgggaagtgctagaaaaggttaatttggcggaactggtacgtgggttacccaatcagctggagacgccgatgaccgagatgggaagccgcttttcaggtggtgagcgtcaacgatttgccttggcacgaattttgctgcaagatacgccaatcgtgattctggatgagccgacggtggccttagatccaattacagaattgcaagtcttgcagaccattttcgcaacgttgcaagacaaaacagttatctgggttacacaccacttgaccggaattgagctggttgataaggttatttttatagaaaataaagcgattagcatggctggtacgccaacgaatttgatgacaacggaacctcgttttcaacgattgttggcgctagaccacggtgatttaccaatcaactaatatgaccaattaagaaaggagaagtgtgatggctaggaagaaaaaacggcagtgggttaaaaagctacgtcagattcacccatcacagttcttcgttaaaaagggtcgtttacaacgtggtcgcgttattttagtagttgcccttgtcggtggccttgcattgtggcaaactgatatacaacatcagcgtgtcgaagcaacgacaccagtcagcgagttgccacttaatgaactaacacatgaacagtttattgcccgtttagcgccagaagcacaaagcttgcaagcacaatatggtgtgaaagcatcaattagtattgcacaagctgctttggaatcggattggggacgttcagaactggcagcgaaatataataatttttttggcgtaaaagcctcagctggcatgccaagtgttacactatctactaaagagttcgttaacgatgaatgggttaccgttaatgctgcttttcggacgtatgctgattggcgtagttcgatgacagatcatgccttgttgttggttaatggcacttctgagaatccacagcgatatcaggcagtgcttcaagcaactgactataaaaccgcagcatacgcattagttagtggcgggtatgcaactgatccagggtatgctgaaaaaatcattcgtatgattgaaacttataacttgaaccaatatgatgtaaattagtaagaaatgaagcgagaagaattatgagcctagaatttttaccaggatcgacattaggtatcctcggcgacggtgtgacaagccgtactttggcccaaagcgcccacaacatgggctataatgtggctgcgtacagtacaaatccggatgcaccggttttggccgaagcagactatcgatttgtcgaacaaggcaatcggctaacggaatttgaaagttttatggcattgtcttcgatggtgacatacacatcctcatggttaccagccaatatgattaccgaattacaatcagcccgtttaccacaaggcacggaattgttggagttaacagatgatcatgcattgggacgtgctttttcagaagcccagtcattcaacattttgccatatgcaactgttagttctttggacgaagtagctcatgcggcggctgaacttggttatccggttgtggtgaagccaatctttaagcacaagcatcatgatgatacagtcatcctccgtggtgactgggacttgggacttgtcgcaccgatgattgatggtggtaccttgatcgttgaaacgtggcttgatgatgcgcaggagtttgccatgactgccgtgcgtggcgttaacggggagattaagacttacccactacgtcaaacaatggttgcacaacaacatttgcgtcgtgcatggacagttggtgatattgctgacgatctcatgacggtgatgcttggtgtgacggaacgtgtcggggatgtcttgcagtatattggggcatacaatgtggcgttcttctacagtgcgaccggtaacttgtacgttcgtgatatcgcagctggcatccaaccaacagcgactttgtatgatgcaacaacgaatgtgtcagttgctgagcaacacctgcgcgccattactgggcaagcgttgactgatgtgcttatgtcgcaagcagccgtttacatgccgtttacggctgatcaaatcgatgcactaagccgtcactggagtatccaatcaaattggaagttttcattctatcaaaacgacatgatgctaccacaggctggacacgttttggcatgtgggtcatcagcaaaccaattgtttaatcaattgcatgttgctggtgtctgggaattcgaagaataatgataaggaggagcgattacgtaacgtattcgctcttttatttggtgaaaaatttaaatttcaatagacgttgttttgatacgaagtgtaagatttgagtgtaggggggattgggaatgaaaaaattaattaaaggcacgctgacctttattggcattgtaattacgatgatgttgagcgggcctttctttcaatctgttatcgacgaatactatgataagcactagtagaattgatagttaatcagaaaaggagtgatttttagaaatcactcctttttattatttttttattcaaaaacaaaataacagatatgataaatgcattagcctatcattgcttttttgttagtattaaattatagtgcagtgagtgttaagggcttgaatgtccattcacatgccttagttttacaggggagtatggataatgaggggatttaagcaacataaaaaaatgtacaaaagcggtaagttttgggtggttgctggtctaaccgtagtatcgctgataacggctaatgatactagtaaagtttttgacttatttagcgatcgattggggagtgtttttgcagcccaaacaaactcttcggcgaccattgatacggtgactgatgctgacacggctacaggcggtagtcgtactgtttcatggaatggttctagtgcttggaattacagcgacgtgactggattggggagctacaatgggtcaacctggacaggcgaccgtgcgtacggaagcacactttataaggacccagcggaagcttattacacaaaactggtggccaatggtgccagcactgccggttatacgtatctgacacgtcaatttgatgcaacaaaaacgtttaccgttactgggtacctgcacccaaacgtccgtgatgctgatcaatttatgcctcgcgactattctgactggactggtttgctcttgacgccaactgacccgaataagattgcgactgcttacgatttttcatctaagggtggcggtggtctgggtatcgaaggcatgaagaacgcctatgcctttggtattgattttcacaaaaacacagataagaatgacccggctgaaggcccctttggtgccttgcgaacaaccaatagctcgggaacattgactgctacacagggaaagcaaagtggtgttgctggaacagcaacatataccgacgggtacaacctatctaactggagcagtacgattaagtatacgttgacatggaacccaactggtagaccaaacggtggcccatcaattgttgccacaatgacaacgaataaaacagagaacagcgagtcttcaagttggacggtagatacagcgaaggccaaggtaacgcttgcaccagcgacagccctgacagtcgggttgaatgccattaatggacagaataagaatgaccaatatgcatcatttgatagtatgtcgggtactttatcgactggtaccacaaccgttaagtatgttgacgccaacgggaacacaatcaaagatccaacgacatttgtggctgcggttggggatatcattggaatcagcggtctgtcttccggagccaaagctggtacagatgacatggcttttgccgcacccacgattcgtggttatacggcaagtagtgccaatgacgtgactgtatcgcaaacagctggtaataacgttattaccattaaatataagggaaccgtacaacaggaagccattgttaacacgaacaagcctgaactatggaacggctcttccgcgattacatcatattggaacatcgatcaaacaaagccacttggtggtagctcgctcgctagcagcattgtcgatgcttctttggtgcgttcaggatataactataccgtgacggatcccaatggtagttcatacgcgacaatgtcagctgcttatgcggcggcgaccaacgcttgggatagtacagctaatacagacggtgtggcatctgatgcatcaccacaaaattggacagttaactacacggcacaatcgcaaactgcctatttgtatacgcaaaattatacgtacgatggtagttcatacgtgacgtctggtacggcttcatatatgcaaggtatttacggtccaactgatgggtcaatttcgttcaatacaactgattcagccttggcaaagtcaggatacacctacacggttcaaggtccgggtggcgtaactgagtattcaacgctagcctcggctcaagccattgagcgatttgataatactaacaatagtggcagttccgacggtagttaccaaacctttacggtaaactaccgtccggtaacgcaaaccacgagtttggtggttgatgggttgtcaccaattaaggcgggttcaactgtggcttcttcagttggaacaaccagtgccgctttgacaataccatacactgatgcatcactttcaactgctggatacacgtatgttgttaagggcccaaacggctcaacgtatagcacgttgtcttcagcggttgcagcaaattcaatttatgatgcaactaataattctgcggctactgactcttcagctcaggtgttcacggtgagttatattgggcaaacgcaatcagcggttattaagtatgatccgaatggtccactaagtgctggtacaacatttgcatcaacgagtggggctggtccgagcgggatacacttataccgttacctatgctggatcagacaagcctgactcagtggcttacacaaccttgtcatcggcattggctgcgcacccacgatatgacagtacggcatatgctggcacaactgatacttcttcacaagcatttattgtgacctataagatcaaccagtacgctaacttgattacaagtgcggttgatacgtcaggaaattcactattgaattattcggcaatcagcgaaattgctaatggaccggcaagtagtacgatttccttctctaacaaggactcacaacttgcaaagagcggctacacgtatgttgtccacgtttatgatcaaatgggttcggcggcatcgctgttgggaacttatacaaccttggcatcagccgtggctgctcaaaagtatgacaatacccaaaatgcgacgaatgctcgtacggatgcctaccagcaacagtttaaggtggtttactcaccaaggacggctacggtaacgtataactttgtggatcaaagtggcaagacaatcagtccggctacttctgcaactggcccggttggatcgaatattccagatggttcaaagctcattcaaggttacacgttaataagttcatcaggtgacaccgatggtaagtttgacgatgacttggtctcaaccattacttatacgtacaaagcacaataccaggcagcaaatgtcgtcgttgatagctcatcaccaattaagatgaattcagctgttgattcagctgctggcgtgacgagtgggtcaatttcattcgcaaagacggactcacaattggcagttagtggatacacgtacgttgtgtatgcaccgaatggctcaagttatgcgacgctttcagccgcaacggcagctaataacttgtatgacaatacggaaaatggctcggggtcatcagactcttcagcgcaaaacttccgcgtgtcatacaaggcgaactaccaatcagcctacattcgtgtacagcaaaattcaccgattaacacagggtcaatgattgagagtgtcacgggcataactgacggttcgatgactttttcaacaacggattctaatttggccgtatctgggtatacccaccaagttgggtatggcccagatgccacacacacaacttattattcaacgctggcagaagcgatgtcagccgctggtggtaagtttgactcaaccaataacacggcttcgaccgatgcggaagcccaacgttttgtcgtgaattacatcccaatgagccaggctgcggtgattaatgtatcagctgactcaccaatcagtgcaaattcacaagctgttatgtcagcaaatgggaagactggtagtaccattaactttttaccaaacggatcatttacgacagctgattcacaattggcggtatctggatacacgtacaccttaacttatggcagtgattcaactagctatgcaacactttctgcagcggtatcggctcacaacaagtacaatgcaaacaacacaacatcaggtatttctgatgctaatcctgatatgtttacaatcacatactcagctaacacccaatcagctgtaatcgcagtgacttcaacgtcaccaatttcagctggtagccttgccgactctgcgagtggttcaacgtcaggcaccattagttttgcaaaggacgaccaagctctaggtcaattaggatatacgtacacggtcactggaccggatggtacggtatacagcaatttggcctcagctctggctaataacggcctatatgataatacaaataatttgggtccaagtgatgtggctgtacagagcttcatggtgtcgtatagtgccgcttaccaagaggcgcgagtaatcttggactcgacaggaccatattcatctcaatctgtggctgacagtgcaagcggagttacctcaggcagcttggggttcagtatttcagatggagatttggccttgtctggttatcattacactgtgtggggtcgttacggttcacgacaatatgcaacattaagtgctgcggttggcgctgaaagttcctttgacaacactgataatggttcggccgttactgatagaagaatccaaggattttacgtcgtttacacagctgatagtcaatcagctgttgtgcaagtcgcaacggattcaccaattaacggagggcaaacgctagatagtgcagctggtgtaaccagtggtagcatctcttttgccgcgaatacggaaaatagcctatatagtccgggttaccactacacggtaacaggacctgatggttcaacgtacagcacgttatcatcagcggtcgctgcgaatagcttatttgacaacactaccaatacaggttcaatcgatggtagtgtgcaatcatttatggtgagttatacagctgactcacaaattgttgttttggcggtggattcgaaatcaccaatcgaccgtggcagtgtcattgattccgttcatggaaaaacagctggagaaatcccgttccgtgggactgacagcttggttaataagccaggttattcatatattgtttactatgaaactaacggtgagcgaagtgaaccttatgcaacgttgtcagccgcacaggctgaccatacgacgtttgataatacaagtaatgacggcactagtgatgcggatatgcaatcgtttatcatcagctacgtagcgttgaagcaacaagccacaattgttggggatgccaactcaccaatttatgctggttatcaaggaccaacgacatccggagtgacaaatggttcgatggctttgccactaagtgacggtgatttgtatgaacaaggatattcatacgttgttacggggccagatggttctgaatatgctacattgtcagcggcatcggtggctaataatgtttacgacagtactaacaatattggaaattctgatgccgatattcagacgttcacggtttcatatgtcgcgcagtatcaatcagctgcattgattgctggttcggcttcgaacttgccgtctaacgttacagctggattaacttttgcttcttctgctggtgttactagtggacgagtatcatttgctacaagtgacagtgacttggctcgttcaggttatcgttatacgatttctacaccggatgggacaacatttacaacgttgtcttcagcactcgctggttcaactggattgtatgataatacggctaatgccggagcatcagatgcctcggcacagcaatatactgtcaattatttaccagaaattcaaacggctcgtgtgataattagtgaaacaactggtgatgagcatgctggagaagtactttcagagtcaacgggtaatacgaatgaaaaaatttcatttacgctatctgatggttcagatttgaacgatacaaatttgcaaaaattggaaatgaccaaaggttatagttgagcatccaaatggaagtacgtctggtccatacgcaacgttacaggctgcgtatgatgataatcctgtatacgacgatgataagaaaggaattacaactttcattattgttcctcaagcctcatatcaagaggcggttgttaatattggctctgctgggacacaatcagactacgcaacgagcgctagcggtgtaacaagtggggcaattaattttggcgacttggaatctagcttggcagtgtctggttacggctatacagtaacggtgacagacgatgatggtaatcgtattgaatatgcaacattgtcagcagctgtcgcagcagttggaaactatgacaacactgtgaatggctcaaaccaatctgatagttctgcacaagcatttgatgttaactacactgccgattatcaatcagctaatgtaacgttctcaggtgcaccaatgtcatcagttgcctttgttggtgagacaagtgcaactttggagtctacgaagttcaccgctgattcaggttactactttgacgctcagcaaccatcatactcaggtgcatcaacaagcgtttcatccgatggtaaagagctttgggtatcgtttacgtacgacgacacaaataactcagcagcttctgatagtgatccacaaaactttgaatttacgttgcaaccggcaacgcaacaaggaaacattatgtactcgtattcaaatgcggttagcgtgccaagtgatgcaccagcagatgaatcattaagtggtaaaactggccaaccacaatcaggcactattaaggcgccatcaggttactacattgcagctatcaatggtgatcaatataatgtgacatacaatgatgccgccacagaagccgagtacaccttgctttgggatgacacacctaatggaaatgcggcgactgatagcaaaccacaaaatttggtggtcatttttgcccctggtaatcaaagagcaacagtcagtcagacaatgccaggtggaacaactacaacggttaacaccaaaaatggtcgtactgataaggattattcatacgaatacactgctccatcaggatattatgtggctgatgatggcattacgacagacggcaagggtcttattagtggtgttattttatctgacggcacaacggtgacgtttaccggaaagtttgataataattacacgaactatgcggatgaaaacggggtaacggaccctgaacctcagaacacaacgattaaactaacggcttctacgcaaatcgcacagttccaaattaaagtctctgatggtgcaacatcagtttcacaaagtacctcgacagttcgcggggatacgggtaaaacgattgaagcgccagatggctacacggatgaggaattgaataaggtgaagggttacacgtacacagttactggcccagatggtgtcgtatataacacaatggctgacgtattagctgcgaaccctaacttcgatgaaactaataatgggtcatcagacactgatgctgaaatgcaacaatttgttgtcaattacaaggctgaccaacaaacagccacaattacacaacaatacgccgacggtgctgagaacactcctgcgttcccacaagcgaaccaaacattgacgaatggtactgatcaaatcacgactggcacgattaccgcgccaaagggatacaagatcgatactgtgccacaagttgcggggatggtttggaatatcgcaacagatggttcttcggcaacatataccatcacgttcgacgtggtagctgataatgacggggccagccaagcagctgttgtcacatatgtccctgttgaacaaaaagtgcgggttgatttgtacgacgaggttggtcgcccattgactgatagccaaggcaagcaacaatacattctgactggtcaaaccaacaataaggttgattacacacagattgcaccagaagtaccaggatatacgttaactttaaacagtcgaaatactgtgttgacatatgataacgattctaatacgacgcaagttgtcaaatatatctatgccgatgtgacagagccagttgtagcaagcgataaggttaaaaataccatgacagcttcaacaaccggtgcgcctgccactgaggctgatttcctgaaggcgattaattatgttgctaatacgaggactgaaagtgatactgtaacggataatcaacaaaatgtaccgggtgacggtattacgatttcgtctgactatgagacggtacttagccgattaaaggctagtggcggggggactgcaactgtaacagtgacggcgatggatgcatcaggaaatacgacggattggaccgttaaacttacgttgattgaaacatcaccagtatcaaaagaagcgaatgtagctaatgcacaattagcgcttgataagctagcgagcgatccaacagctgctacggatgatgttgcgactgcccgaaagaatcttgaagatgcgattaacgaggctaaacaagatcgagcgactgcagaagatgcagctaaggcagcccaagatgtagctaatgctagtgttgagtctgctaatccacaagttgccaaggcacagaaagatttgcaagatgcattggatgcagctgcaaatgataagggtacgacccaggcaattgagaatgcgacaaatgcgttgaatcatgcagtagctcgggctgaggcttcttcagtagatactgcaccggtttcacaagaaccaggtgtgacagaggctcaacaaaaggtaaataacttgttagaccctaatagtactgcaaccactgaggaaattaagcaagcaacccaggcattggaagacgccgttcaaacagctaaggcagagcgagatgtagctaataccgatgcaaatgacgtgcaagaccaagtagcggatactagcagtcaagcggtgaaggatgctgttcaaaagttggaagacttgcaaactcaggcagcagcagatggagcaacaacgaatcagattaagcaagcaactcaagatgttgttgatgccgtcaagaatgccgctcaggcagcactggacgcaagtacaacaccagttacaaatgaaccaagtgttcaggatgcaaaatctgcgttggaagatgtgctaaatgatccaaatagcacaccaaaggaaattgttgatgcaacaaacgcctatgagaaggcggttgctgatgcaaagcttgatcgtgaggatgcaaacgacttggctcaacaagagcttgaggaagcgaccacttctgatcaagcgactgatagcgccgtactagaggcgcaaaagaagcttgcagacttgctagagaaggcagctaacggtgatgccactgcgctaacccaagatattgctaatgccaccaaggaactgcaggatgctgtcaatgcagctggaactgcacagacaacagctagaacggaggcaaatgccacacttggtcaaacggcaccggtttctaatgaaaccgatgtaagtgacgccgtgaagaatttgcaaacagtcttaggtgacccaaagtcaacagctgatcaaattacaacggctactaagttactccaagatgctgtggacgatgcgaatacacaacgtaatgcggcaaacagcaatgcagtgtctgcgattaatgcagccagtgcatcaaaccaggctgatgagccagaagttcaagcagctgtacagaagttgcaagatttgattgatcaagctgccagtgattctgcagatgcgttgacgcaggatattattgatgcaacaaaggcattgcaagatgtggttaatgttgcagcaacttcacaagaagacgcgcgtcaagcagctgaaactgcgttgggtgatactgcgccagtttcaaacgaagtggctacgtcagcagcgggtacagagttgaacactgttttgaatgatcccgcggctacagtcacagcgattaaggaagcaacacaacaactccttaatgcaactgcagctgataagtcaaatcgtagtgatgccaataggcaagctaatacagcaattagagatgcgcagaactctaatcaagcaggggaacctgaggtgattatcgccttgcaaaagctaaaggatgctcaagcgcttgcagctaatgattcatctgcagcactgacacagactatcttggatgatatccaagccttaaagaatgctgagcagattgcatggcaaaaccaatcctctgcacgttctcgtgcagaggaggcaatggataacacaccagctgtcactaatgaggcgaccgtacagagcgcgttagataatctaaataacgttttgaacaatccaagttctacggttgctgaaattgataatgcaacgcaagcactcactgatgcaacaaacacggcgaaggcagatcgtgatgcagctaatcagaaggcggatacagcaatttcgaaggcgcagaactcaaatcaaggtgcgaaacaaactgttcaagatgcaattcgcgctttgcaagaagttcaggaagaagcagcgaatgactctgcagatgcgttgaccgccgatatccaacaaaagatagcggaattgcaaacagcagtgacagcagcagctaagacccaagaagaagcacgtaactcggccgacgatgccaagcaacaaacagcgcctgtaaccaatgagccagctgtacaaacagcattggacgagttgaacgaggtattgaataatccggcatcaacggcagatgctattaagcaagccacacaacagttactgaatgccactgaagatactttggaagatcgtgatgcagctaagctggatgcacaaaatgcgattactaacgcgttaggatcagatcagtcagctgaacctgctatccaagcagccattaagaatttgcaagatgttatcaagaacgcaaatgctgattcaccggatgcgttgacagaagatattaaaactgcccaaaaggcgttggaagatgcgatatcgggtgctgacgccaagcaacaagaagctcgtgatgcggcgcaagacttaatcggcaagacggcgccagtttcaaacgaggtagcaacggctcaagcccgtaacgcattagagtctgtattagctaatacattggcgacagcaaacgatattgaagaagctacctagactttgcaggaagcattagcagctgataatgaaaagcgtgatagtgcaacaacgactggtaatcagttaattgaaacaactaatgcgggagcaacatctaatgagccactggtgcaaaaggcattggctgacttacaaaatgttgttaatgaagcagcaatggatacaccaaacgcgctgactaaggatattcaagccgcaattgatgccttaaacgccgctaacgatacagcgaaagttaatcaagcaaccgctcgagaggcagcagacagtgctatctcacaaacggcgccggtatcaaacgaatcagcagtgaaggacgcgcaagacaaactacagagcttgatcaatgatcctacgtcaacggctaagaatattgagggtgcaacaaagacgctgattacagcaactgcaacagctaagagcttgcgtgatgacgccaatgatacggctgaaacaacaattgacggtgtacaaaatgatgatgttgctaatgaacatagtgttcaagccgcaattgaccgtttgcgtgatgtcatgaatgaggcagctgctaataacgagaataatttgacagtcgatattcaacgagcaaccgatgacctgaagaatgacattactgcagctaatacaagccgtcaaacagcggttgatgcagccgaaacattacttcaacaaacagcaccattatcaaatgaatcggcagttagtcaatcggcagataagcttaatgatttgttggatgctctcaaggatgatgttgtttcaaatgatccaacaaccgccgaacttgaagtggcaccaagggcttacaggacgcactgcaagcagagggtcagaagcgtacaacagctaataacgcagctgaaacagcgattgaccaagctaagcagtcaaaggtcgtgggtgattcggccgtacaagatgcgctaaaccacttacaagatgtgatgaataatgcggcaaacaatgatccagatgccttgacggcggatatcgagtcagccacgaaggctgtacaagatgcgatgaacgcagctaagtctgaccgtgacgcagcgacaaccgatgcgaataacctaattggtaaggtggcaccaatttcaaatgaaccaggtgttgcagaggccttgcaaaacttgcaggatacgttgaatgggacaacaactggcagcgatatccgagatgcaactacgaagctacaacaagccttggatgcggcaaacgcagctcgtaacacagccaatgatgctggcaagcgagcaatcactgatgcgaacgtttcagcggtcgccactgatccagcggttgtatcagcgatgcgacacttgcaagatgtgatgaataatgcagctaatgataatccagaggcattgacggcggacatcgaagtggctattgaagccttgcaatatgcgataactaatgcgaaaaaccaaggaagtggggagcacccaacggataacacaccaggtgaaactgaaccaggcacaaccttgccagattcagttacgactgtaccggcccctggacaaacgcctgagcttgtcgatgttatgccatcggtttccgattctgatgcgccaattcaactcattgaaaatagtcagccacagattgtagcaagtgcatttggaccaggttcggttcaattaccatatacagcggctgacggccaacgacagaactggcacatggtatcacttggaatctacttgttctcaacaatgttcttgcttggggctactaagcgccgaaagaatgaagataaaaactagcggatagtctaatagaaaaggagtgaacacactgtacgggatacagcgtgttcactcctttttggttgaaaaacggccagtacagaatgtgtactggccgactctcatctcaatatgcaattaacccatcatgacttggaacaatgtgataaagacaccaaggaatgacagaatcaacatcaaaatgacaaatccttggataactttttgcatagtagacttttgcttcttctttgccatgaagtaatcctctttttcttaattacatctattgtaccaagatttcagttcaaatggcacagacgtttaaattcacggtataatataatgattgaagaacgaaaaggggaaacaacgatatgcttacaacgcttgactggcaattaacggttgccttagcatttgcgacatggattgggttgattttgtttcaccgcttgtttcgccgtttaacttggccaaagtggatgcgccccattgacttagcgactttggttgcttggtgggctatcgaggtcattagtttccaagtgtggcacctttctttattgccgccaatcttgtttatgtttgtattgtggggcattggcttggcattgtatcaaggttttgttcgacaaacatttacaacgaagacgttttggatgatgtggtggcgcattgttggattaggtagttttgtagcgttgattggtttagccatcttcgcgttcattttaacgaaatagagagaataataattatggaaaagattgatggatacgttaagacttggaatgctgacaaggggtttggtttcattgaattgaagggtgaagatgacgtgtttgttcatttctcagcaattgaaacacctcatgttcgtgacttggaagtcggcgaaccagtaaagttggttgttgtacaaggcgtacgcggaccacaagcagcagcagttgaagtttggagctctgaggagaactaacatggcggatgaatttgaagcaaagtttcgtgaagaagttatttcagaagaagaagtatacaacggccacattattcgggtagttaatcaaacggttacgttgcctgatgggcgtgagtctaagcgcgaggtggtacatcacagtggtgctatcgcggtgcttgctttgacggatgacgataagatgattttggagcgtcaatggcgtgcaccagttcaaaaagtaacaactgaagtgccagctggtaaggtagacggtcgtgatcacaatcctttggatacagttaaccgtgagttgaatgaggaaactcgtttgacagctggaaagattgaaaagattgccggtttctacacgtcaattggctttgctgatgaattcatgaccctatacttggcaacggatttgaagccagtgactgatgagttaccacaagatgacgatgaacaaattgatttgctttacgttgattttgatgaggcaacgcgattgtttgaggctggtgagctagatgatggtaaaacagcgatggcgtacctttactggaagacgcttcgcttggcgggtaaagcgtaatgtttggattcaagcgtagaagacaggatgaaaacctctcagatgaagattatagcttcgctggcgagtttgaaaaacccgaaaacacgcaggaacgactaagccgattgcgtggtgagtctgagccaacgaatacgccgctgacccgcgaagagcatcgtttaagtggtaaaggacgttacgaattggatccggtaactcgccgcttaacggaagctggtaagacggcccgtctaaagcgccggttaaatatcacaataattgtgttgattatcctaattgtggtaacttacctagtattgttcctactatagtaatagaagtattaagttgaaagtgagattttgagagatatgcgttacggtattattaatgcaatggccgaagagaaggcagccctagtggcagcaatgactgatgaaaagcaatcaaccattgctggtaagttgttccaccacggtaagattggcaacgttgatattgttgttgttgagtctggaattggtaaggttgcgtcagcattgacgacgactttgttgattaccaattttgcggttgatgccgttattaactcaggttcagctggtgctttgggcgctgatttgcgcattggtgatgttgttgttgccagcgaattggcatactcagacgcagacgcacgtgcttttggttatgactatggtcaagtaccacaacaaccagcccgttttgtaactgatgcaacgctttcagctggtttggctgaagcctatggggatgttacggacgcacgcttggttcgcggtttgattgtgacgagtgattcatttatttcaggtgatgagcaaaagcaaaacatcttgaagcacttcccagaggcccaatcagctgaaatggaaggggcatcaatcgctcaagttgcacactactttgatgtaccatttgctgttgtccgcgctatttcagataacgccaacggtgaagctggtccaactttcgatgagtttattatcgaagcaggtaagcaatcagcacaagtgttgatcgacttctttaacaagcaataatgatgaaggctgttattccatcttggggtaatggcctttttattttgcgtcctcccttatcgaatgagacgttaatcacggcaataaaacaagtttcctactataatatagtcagcaatagggaataataaaattaacttacaaaaagtacacctttttatttcccatttaaatttacttctggtattctaattacattcaataagagaatcacataaacgaaggagcatccgaatatgactatccgtggaattcaccacttgacgacgattacgtcagattcaccaaagatttttgatttcttctcaggtgttatgggtcttcacttgattaagaagactgttaaccaagacgacgtacgtacgtaccacttgtactttactgatgacatgggatcagctggaacggttttgacgttcttcgacttcccaggcatcaacaaggccatccacggtactgacgaaattacgcgtacggctttccgtattccatcagatacatcatttgattactggatgaagcgttttgacgaatacggtgttaagcacgacgctgaaactcacgaagagttcggtgttaagtacttggacttcgaagacttcgacggacaattgtacgccttggagtcaaacgagaagaacacgggtacttgggctgaaggtacgccatggcaatactcatcagttgagccagagcacgctatcctaggtttgggtgcacaattgttgacgatcaacaacgagaacgctatgcacatggttttgacatctgtattgggtgctaaggaagttgctcgcgacggcgatgacgttttgtacgaattcgacaacgctggtttcggtggtcaagttcacacgcgtttggtacgtttgttgccacgcggtttgcaaggttacggaaacgctcaccacttcgccttggcagttgatgatgaaacggctttgaacttctggatcaaccgtttgcgtcaattgggattccaagactcaggcttcgtggatcgattctacttcaagtcagagtacttccgtccaacaccaggaatcttgttcgaaatcgctacgaacggaccaggattcttgcaagacgagacgtacgaagaggctggacaccacttggagttgccaccattcttggagaacatgcgtgacgaaatcgaagctggtttgattccatttaactcagctgaagatgatttgccatcaccagaagtgttcaagaagaacgtttctgataatgtagaaaactaattaacatgattgaagcaggacgtaagcagcgcttatgacctgcttcttttgtatccggacactatcgcttgttaaaagttagcgcttacaggtataatggaaacacaatttgaacggagaataggacgatggccaagaaaaagtataagaacaatattcgacacgcctatgtatcaggtgatcctgatctagcccctttgctattgctacacggtactggtggagatgaaacggatttgcttgaaattgccgaatttatggcacctgagaacccaaagatttcgattcgtggtcgtgttagtgaaaacggtatgaatcgttattttgaacgctacgaagaaggtgagttcaatctagagtcacttcacgcagaaacggattggctggttgatgcagttcacgagctttctaagcgttacgaattgcacgaagaatcaatgattatgatggggttctcaaatggggcgaacgtcggggcacacgcgatgatggctcgagaagacacgccatggaagacggcattgttgttccacgcgatgtcagttgaacgtttgggtgatgatattcaagatttgacggattcacgtgtctttgcaacgttcggtgagtttgacccgattatttctgaaacaaactttgatatgttgactgaagacttgcgtaagggtggcgcgttgttgtctacatttgcgacaaagacgtcacacacgatgtcacaacctgaaatgcaagctgctaagctttggttggatgccaatgacttgttggatgttgatgacgagcctgaatggccagcgtcattgatgtacggtgcggatgaacacgaccgtgaccacggacacgatcacggacatgatcatggtcacgaccaccaccaccacgagaaagatgaccatgaatggcattatcctgatggtcaaccagccgacgatgaagatgtagtggaaaagttgcccgaagactagtaaacttattcacataagaactagttaagaggagatgtcacgatggcatttgaaacaacggtaaaagtacctggggattcagtaacttaccattttaacccgcaattaaagaagtatgcattgggcgacactggttttgtaactaacaacgccggtgcgtacgttatgcaacgttcactagagccggctaagggtcttgcaaacgcaattaagcttaaggtagtagtgaacaaggacttgacgggcatgaaaattaagacagttaacccaaatggggcagcaactgttaatattttcgcccgcaaagacaatgaagaaatggtcgagttgtaccatttttacttgaatgagttggttgatcgagaaattttgacggttgattaatatcaataaacagaaaagagcattccagcatcagttggaatgctcttttttatgcatgaaatgttaaggaatcctttagtttagggcttttctggcaattgtcttctttttaaaagttaatgaaaaattgaatcgttacttttatattgtaacaaacgtgacataaaaggggcgaataaactaaatttaaacctaattttgcgtaattagtcccgaaaaagcccggaatgtggcgattgttaactggttaatgatgttttttaaaacactattctaatcgacgtttgaacacttatttttagtaatgttacgtaaatgttacacgaaaagccggattaggcaattatgacgttacgtaatgactttattttgtaacaaaacgactgttctgattgataaactaatacatgttgttaagagatgcaggtgtcacacattagcgatgatcctagtggcgtgtacctgttagtaattgaaaagatagagttaattagaaggagagtttttccccatgaataagaagatgattactgcattgactgttgctggcttggctacgttcgctatggccgaaaacgcatctgcagatacgtacacagtacaatcaggtgacacgttgtcacaaattgcagctaaccacaacacgactgttgacactttggttgccaacaacaacattgctgacgctaacgtaatcttcgttggccaacaagttgaaatcgatggcgttgcttcaaacgcttcatacgacgcaacacaagctgatgttgctgctgttgttgcatcacaagcacctgttacgcaacaagtatcatacacggcacctgttgcaacgactacgacaactgcagccgcttcaggttctacttacgatcaatttatcgccgctggtggaactgacgctttgtggactgctattgttatgcccgaatcaggtggaaacccagacgcatcaaacggtcaatacaagggattgggtcaaacgaaccaatcatggggaacgggtagcgtttctgaccaaactgcaggtatgttgaactacgcaacgtcacgttacggttcagttgattcagcaattgccttccgtgctgctaacggttggtggtaagatactgctttaagtaattaaataaatcgataacacaaaaccgccacgcttctagtttaaagcgtggcggttatttgtttactctgctttgtgatttttagctgcttcggggaacgttagtacggaacctttaataggccacatccagtacttgtcgtttgcgagaagctgcatttgtgttgagtagacatcgtttggcgttgcaactgtggtgatgtctgttaggtgactaaaatcaaaacgattaggcactaatatttgtgagaccaagtgtcggtcatcgtcaattaaaatgccttcaccctgatcgtcgtttgcaagaataagtaaacgttccatgatatgctccgttctatgattagatgtcacggaataactcttgccaagcagctttattcaacttcggcttcttgcgtcgtggttggcgttcttttggtacgtaagttgcttttttgtactgacggacaatctcagcctgtacatccttttccaagggtaattcgttggaaacaaaatcaactgcgtcaatcgggaaattaggatatgcggtgtggttatcaataaaccaggcgcgcatctctgaattgaggccagcatgacgacgaatacgttgcaatagttcatcgagaccaaagtccaagtggtgaatttgagtctgcaattgacgcataacagcttctggaataccaatgtggtcagcaaagtgagtgatgccaagcttgatgagcttaccatcttcgttttgcaacacatattgatgcttcaagcggcgaccacagtcacaatacagctgtggtccagaattgctatcgtaattgtcattatagttgtaggcaacgaattcccaatttttaccatggccaaccaaattctggtcaacaaacaatgaagtgtgttgatagcgaatgtgttgtttcaagacagcctgctgttcgggcgttaagttatgccatgtttcttgtcgtcgctcacgagttagagcgactttttttgtttttgcagttgccatttgacgctcctttcatggttaaatcgcatgacaactattatacgcttgcttagtacccggcctcaactagacgttggcgcatggccttgtagacgcgttctacatcgcgggttgtgccacgtagctcgtagttagcaatgacaggtgcatcgaaggcctgagcgtaacgtcgcgctgtcagaatatactgcgcattgaaattcttattaccagacccaataatgcccaataattgttttgcgttatcagcagcagctatctggtcgtagagtgcattagtcataatttcatgcacgccgttatcgataccattgccaccgtctaaataagttgggactaaagcaaaatagggtgcgacctcatcggtatcagcacttgcatccgagatttctacgggttcaaagtcaatgtcaccttgttcgtgagcgaaagtcaccaggtttttaacgaaggaccgcgtatttccggaaattgatatatacaaaagacgaactttcatgatgttttcctcatatgtttctttaccatttattccactatacactagcacaatcacaaaaaacacaccctttttgtacataacggaaagttatatttaatgattttgtaataaactattgggaaggttgatatggcggtaaatagcgctgtcaagcctttttttcttcaaaagttacgccttgcattctgttatgtacctgactatactcagagacagatattagcaaatgtcagaaaatataaaaccgaaagataaaggtgaataatatgcaaaatgttacggtatatacgaagaacaactgcgtgcaatgcatgatgacgaagaagacgttggcgcaatacggtgtcagctacgttgaaaagaatgttgaagaagatgaggcagcattgactttcttgaaggaccaaggttaccaagctgtgcctgttgtatttacaaacgacgctgagccaatcaagggcttccgacctgacttgttggcacaacttgccaaggcaatgtaacaagacgaacaactagttgttggcaagactacctaaacgtcggtgcagccgtgggggttccgctttacgttaggtaacacgggggaaaagatatgtcacttgctactttggacctagataaggtcacctactttgatttaaataatgaattaaatattcccaaggataacagtattcaattgggaaaagacaaggaagctttggaagctttcttggcagaaaatgttcgaccaaacacactccaatttgattctcttcgtgatcgcttcgattacctaattgaacatgattttgtggatcaaaagatgttggacagttattcatttgcgttcattgaacgtttgtatgactatctaaagagtcaagatttccaatttaagtctttcatggctgcgtacaagttttatgcgcaatatgctgttaagaccaacgacggggatttttatgtcgaaaactatattgatcgtgttgccatgaacgcgttgttctatggcgccggtaatgaagaattagccatgaacttggctgatgaaatgattcaccaacgttatcagccggccacaccatcgtttttgaacgccggccgttcacgacgcggtgagttggtgtcatgttttattttgcaaacaactgatgatatgaatgcgattggtcgtgtgattaactcagcattgcagttgtcaaagattggcggtggggttggtattaacctctcaaacttgcgtgaagcaggtgcaccaatcaagggtattgcgaatgctgcttcaggtgttgtgccagtgatgaagttgttggaagattcattctcatactcgaaccaaatgggacagcgaaatggggctggtgtggcttatttgtcagtattccacccagacattatggactttttggcaactaagaaggaaaacgcggatgaaaaggttcgtgtgaagacgttgtcacttggtgtaacggtaccagataagttctacgacttgattcgttcaaatgctgatatgttcttgttctcaccttatgatgttgaacgtgaatatggtgagccgtttaattacgtggatatcacggctgagtacgacaacatggttcgtaacccacgcattaagaagactaagattcgtgcgcgtgacttggaaaacgaaatttcaaagatgcaacaagaatcaggttatccatatgtgattaacatcgatacagtgaatgcagctaatccaattcacggaaaggttgtgtcatcaaatctttgctcagagattttgcaagtgcaaaaagcttctgaaattggtaatgatcaacaatactacaagatggggtcagatgtttcatgtaacttggggtcaactaacatcgtaaatatgatggaaacgactgattttgaacgttcagtggacacgatggtccgtgctttgacgttcgtttctgacaactcaaacttggatattgtgccttcagtgcaaaatggtaatcgcgaattacacgcggttggtttgggcgcaatggggttgcacgcattcttcgctaagaaccatatgcactatggggatgaagaggcgattgacttcaccaacgcctacttcttgatgttgaattattacacattgctagcttcaaacaagattgctaaagaacgtggtgaatcattctttgagtttgagaagtcagcttatgccgatggttcatactttaataagtatttgatggctgattggtcgccaaagactgataaggttaaggcgatttttgagaagcaccatttcccaaccaagcacgactgggcaatgctcaaggaatcaatccaaaagcacggtttgtacaatgcttatcgcatggcgattgcgccaacgggatcaatctcatacgtgaatgattcaacggcatctttgcacccaatcattaacaagattgaggaacgtcaagaaaagaagattggtaaaatttactacccagcaccttacttggggacggatacattgccgtactacgaatcagcttataacttggatatgcgtaaggtgattgatgtctatgcgacggcacaacaacacatcgaccaaggaatggcattgacgttgtttatgcgttcaacgattccggctggtttgtatgagtggaagaatggtcgtactgacaagatgacgactcgtgatttaaacatcttacgtatgtatgcttatcacaagggaatcaagtcgatttactacgttcgaacttacaccgatgatatggaagagtttggcgtgaacgagtgtgaaagctgctcaatctgattaattggagttggtcacattaaaaatttagagctggtataatcaacaccagtagctcggaaaacggtcagtgagtgaataaattcctggccgttttcgtatgaaggggagaaccgcgaatgactgaaggatatgttgcaatcaactggaataatgttgaggacgcaatcgacaaggcaacttgggaaaagttgaccgaacaattttggctagacacacgtattccattgtcaaatgacctggatgactggcgtaaaatggctgaaaacgaacactacttggtcgggcacgtatttggtggcttgaccttgctggatacgctgcaatcacaagacggtatggcatcattgaagaagtctgttcgtacgcaacacgaagaagccgtattgaacaatatcgagttcatggaatctgttcacgcgaagtcatactcatcaatttttgaaacgttgaacacgccagcagaaattgaagaaattttcgattggacaaataccaacgaatttttgcaatacaaggcacaacgcattaaccagatttatcaaactggggatgacctacaaaagaaagtggcgtctgtatttttggaaacgttcctgttctactcagggttctacacgccactttggtacctaggccacaacaagttgaacaacgttgctgaaatcatcaagttgattcttcgtgatgaatcagttcacggaacttacattggctacaagttccaattaggcttcaatgagttgcctgaagataagcaagaagaaatgaagatgtggatgtatgacttgttgttggatttgtacaacaacgaagaaaactacacgaagcatctatacgatgagattggttggacggaatctgtactaacgttcttgcgttacaacgcgaataaggcgttgatgaaccttggtcaagatccgctgttccctgatggggctgaggatgttaacccaatcgttatgaatggtatctcaacgacaacttctaaccacgacttcttctcacaagttggaaatggttaccgtttgggtcaagttgaagtgatggaagatgatgattacaacattggcctagattaggttgcattacaaaaattaaaatgttatcataattttcaagatgaaacgttaggtggaaacagttatgtttaagacgacagtacaattgaatggttggtggcgcagctaacgcgtccgaactgtggttgaagcagattcggtacgtgctcttttggagcgtaagtattgagtctgtgccgactgatttccgttaacgaaaggtctgcacgggttaccgcgcaggcctttctttttaccgcgaaaggggcacgcaaggtgactctttcgcggtttttattttgcaattatttacggggtaaaggttatgaacaagaaagtattgactgctgtcggcttactagctgcagtacttgttgcagcaggggtccaagaatcaatcgcggaacacaaagcagctaaagttccaacagtgggtgtgttgcaatttatgtcacacccggcgttggatgcgattaataagggtatcaaagagggcttagcagatagtggttacacagtggggaaggacgtcaaaattgatttccaaaatgcacagggtgatcaatctaatttgaagacgatgtcgacaaagtttgagaatgagggtgccgcggtttcagttggaattgcaacaccagcagctgttgcgttggcaaacacaattaatgacaagccagtagttttctcagcatcaacgaatccgttgagtgccaagttggtgaaaagttataacaagccggggggtaacgtcactggggtttctgatcaggcgccactcgaggcacaattgaaaatgatgaaggcgtttttgccagagatgaagacgttgggtgttatctacacatcatcggatgattcagcaaccactgaagctcgcaaaatgattgcattggctgaagaagcaggactaaaggtgaaggcgtactctatcgcgtcatcaaatgacttgaaccaaacgtcattacaaatggttgaaaatcataatgtcgatgcggtatttgtgccaactgacaacacaattgctggtgccatgacgacattgattaagaacacagacgctgccaaggtgccagtgttcccaacggtcgatacgatggttaaggatggtggtgtcgctgccgagtcaatcaaccaaaaaaacattggggtcatgactggaaagatggtcgcgaagattttgaagggtgccaaccctaagacgttgccagttgattttacaaagactggtgaattggttgtgaacaaggcccaacttgagaagttagggttaacgatgccaaagggctacgatcacgcaaagttcgtgaagtaaggagaacggtatgaatattttagtttcagcgattgggcaagggcttttgtgggcaacacttggaattggactctttttgactttccgtatcttggactttcctgatatgacagttgaaggaacttttcctttaggggctgcgacggccgtgacattaatttcaaatggtatgaatcctggcttggcgagtttaatcgcagctggtgcaggtgcattggcaggtttggtgaccggtttgatttacaccaagggtaaggtgccaattttgttggctggtattttgacaatgacggcggtttactcaattaacctgcgtatcatgggtcaggccaaccgttctttgcttggaaaaggaacgctattttcagcagatttccttgatttcttgcctaagaacttcccaacggtggttgttggattggtcattattgttgtcgtaacagcagcaacggctattttcttgcaaacggaacttggtcaagcgttcattgtgacgggtgacaaccgtgcgatggcgcgttcacttggtgttaacacagataacatgacgattatggggttgatgatttctaatggtttgattggcttgggtggtgcattggttgctcaaaataacggctttgcggacgttaatatgggaatcggtatcatcgtcgtcgccttggcgtcaatcatcattggtgaggttgtgtttacagaccaaatgtctttgacagatcgtttggtaacgattgtcattgggtctgtactgtaccgctttgtattggttatcgtgctttacttgggcttcaacgcaaacgatttgaacttgttcagcgcggtggtacttggtattgctttgacattgccacagctacgcgaggtgttgaaactagatagcgttttgaagaagggggttgcctcacatgactaagacaagtttacgattagaaaatgccacggtggtggttaaccaaggcacgcctgaagaaaaaataatcttgaataatgtttcgttgacgttgaacgaaggcgattttgtcacagtgctggggtctaacggtgctggtaagtcaacgttgttcaatgtgattgccgggtcgcttgcattgacgagcgggcacatttacctaggtgatgaggacgtgacgcgcttgtctgaaacccagcgcacaaagtttttggcacgtgtgttccaggatccaaaattaggaacggcgcctcgtatgacagttgcagaaaatttgttgttcgcggaacgtcgtgggttgtcacgacgcttgaagggacgcggattgaccaaggaaaagatggctgactttgctaaggtcgctgcaaagatgggaaatggtttggattcacgtctgaatgttgcgacgggtgacttgtcaggtggacaacgtcaagcgctatcgtttttgatggccacgcgtttgcgtccagaattgttgttgctcgatgagcacacagcagctttggatccgaagactagtgagcaattgatggcggtcaccgacgaacgcattcgcgaagatcatttgacggccttgatgattacgcaccatttggaagatgcgattcaatatggtaatcgtttaattatcatgtcggccgggcaaatttcattggatgtgtccggtgaagaaaaacaacaattgacggtgcctgatttgttgggttactttaatcgttattaacataagcataagcgagggtagcatttcggtgttgccctcttttttgatcacagacatattcaccccatcgcggggacaaaagtggtaaattaaaaggtgagtttttttacggaggtgtgagatgaaaattgatcggacacgcttgctaacagttggtcgagccgtagtggtcggcattctggttggtatcgtcgtcagtacatttcgttggttggttgagctgattctagatcagtggcgccatgtctatcatcaacttgttgtatcaccagataaggggttctggttggccggcacaataattgccatgattctatttacattcattgttggccaaatcattaagggtgacccaaacgttaatggatctggtattccacaagttgaaggacagttagctggacagatgacggttaatccgttttctgtgttgtggcgtaaatttacagctggactattaacaattggttcaggtgccatgcttggtcgcgaaggcccatcaattcaactgggggccgcggtcgcccaattatatggtgagaagcgtggttttgattcccgtaataacaagttaatgattgcgatgggtgcggcggctggtttgtcagctgcatttggtgcgccggtcgctggtacattgtttgtacttgaagaggtttatcgcacgttctcaatgctggtatggcttggtgcgttgacgagtgccgttgttgcggacatggtatcagttaatgtttttggcttaacaccagtgctaagtatgacgaatttgcataacttgccgttagttgattatgcctggttaccagtattgggtattttgttgggcttgtttggttacgcttatcagcgtgcaaccttgtgggcaccaaacatgtttcgttggttaaagtggctaccacgccattaccactttattgttgtgttcctgttattgattccagttggtatctgggcaccgcaagcccttggtggtggggcgagcttgattttgcatgacgctaactttgtgccgacgattagtgtcttggttggtctaattattttgcgctttgtgtactcaaccattgcgtttggttcaggggtgccgggtggtatcttcttaccaattctaacgttgggagcgttgtcaggtgctttgtttggtgctgtgcttgttcattttggattgcttgcaccagtcaatgtgatgaatatgatgattgtcgggatggctggttatttcgcaagtatttcaaaagccccatttacagccatagtgttgattgctgaaatggtggggtcgatgacccacctggttgccatggcaattgtagcgttaattgcttatctagtggtcgacttcttgggtggtgaaccaatttatgagtcattgttggctcgcctgcgtttgccagatcaattatcagcattgcgtggtcgtttagaagaaatgacgttcgttgtggcgcctggtagtgcgttggaagatgcagaagtgcgtcaactgcaattgccacgcggtgttttgattcaacgcattcgtcgtggtagtgaagaacacttgcccaatggcgatttcatcttacaagttggggatgaattgtcattgctaactgacgaggcacagttcaaacaagtttggaccgttatgcaagatttgaataaggaaacggagcaacaaaatggataagttattttggcaacgtttggtagctgtaggagttggtggcttttttggtggcggactgcgtgagctagtcgccttacttattcaagtacctgcttttccattatcaacgttggtcatcaatttaacgggcactttcttatcagcgtttctggttgtgatatggtctaagaaaatcactttggcgcaaccggttgctgattttatcatggttggagtgctgggtgcttataccacgtattcaacggctatattagatatggttaaacatggttggctaattggctttgtctatattgtcttaagtattgtcggcggtgtattagttgtgtatgctggccgtgcactagctgaaaaggtggtggcttaaatgttaattcaagttggcttagcaggtttaggggctgttatcggatcgatgggacgcttttcattattggaaattgcaccgaaagttttcgggacagctagtgcttggatggtgatggttattaatttaacagcggccttcttaatcggtattttgttcggtatgcatttgccagttttgcagaatacattttgggcgacgggaatcatgggtggttattctactttttcaaccccaatcgttgaattagctaatggcttacctaatcaatcagaacgtacccgtgtcttgctgaaaaccgttttggcgtttgcaggtggtgtaccggtattattggttggtttttggttagggtcgctattctaaccgtttcgtgttaaattgatacacgacatatacaattttggagttggatattatgagtaagattgcagttttagttgatagttctagttacattgcgccagctgatttggcagcattgaacatctatcaaatcaatgatcctattatgatgggtgagcaagtttttcatgaaaatgagagctgggcatcacaagaggagttctacacatttcaacgaacagctgaaccggctttgacgacatctcaacccgaaatcggggcgttcatgacgaagtttgatgaattggctgaggcaggttacacggacgtaatcgtcatcgtgttgtcatcaggaatttcaggtgcattctcatcacttgaatcattggctggtacggtcgagaacattaaggtgcatgtgtgggattcacaaattgcagctagtggggcaggcaatcaagctaagttggcggctgaaatggttgctgctggcaaggacgtccaaactatcttggctcgcttggaagagctacgtgccacaacaaaggtgttgtttgccgttgatgaaattcgtcatttgcaacgcaccggtcgcatctctggtgggcaagcaacgttaggtgcattgcttaacattaagccattgctaacgtttgaagacacaaagattattgctattggtaaagagcgggctatgaagcgtgcttggaagaagattgaagctgactttcaggcggttcacgatagtgttgactacaagattcgtgccacgattgtggatggtaacaatcctgttttagctgatcaatgggcagctgatttagctgaattattcccggatgttgttgttgaacgtagcatcatcggaccttatattggtgttcacactggtgaaaaggcaatgggtcttatctgggcacgagactacaaaacattggaaaattaagaaaaaggtctataccaactattgcgtggtatagacctttttagcattgtcaaaatagggcataagcgtaaaatagataacattggtatacaaaatatctttaggatttataagtaggggatttacaaatgaaggactatctacaacgaatgggtcgttcattgatgttgcctgtttcagttttgccagctgccgctttgttggttggtattggaaactggattatgcgcattgatggtacagtcgcccaatcgattggaaactttttagcgattgccggtaacggtgtcttgggccaattggcattgttgtttgctgtcggtcttgcgcttggtatggtgcaaaagaaggaagccggcgccgtggccttggctgcggttgtggcatatgagttgcccgtattcttgttggcacctgcacaaattgccacgttgacgaatgtgaaagttgcccacgttaatccagcgtttgaagcgttggttaataacaacgtcttgcttggaatcgtagctggactagttgccgctgctttgtacaaccgctttagtgaagttcgcttgccaacagcgcttgcgttctttagtggaaagcgttcagtgcctatcatttctgcggtggcgatgttggtcatctcagttgcactgttgtttgtgtggccaccagtttacacaggtttggtaacgtttgctaagttcatctcaggacttggttgggttggtgccggtttgtatggattcttcaaccgtatgttgattccaacgggattgcaccacgcgttgaactctgttttctggtttaacattgctggtattaatgatatcggaaattactgggcatcaactggtacgaagggtatcacgggtatgtatcaagctggattcttcccagttatgatgttcggattgcctgccggtgcatttgcgatttaccgtcaagctcgcccagctcaaaagaagcgtgttggatcattgatgttggctgctggaattgctgccttcttcactggtgtaacggaaccattggaattctcattcatgttcgtagcatggcctttgtatgttatccacgctattttgatgggattgtcattggcaattgcagcctttttccactggacgtcaggatttacgttctcaggtggattggttgactacgttttgagtttctcaatgcctttggctaacaagccatacatgttgcttgttcaaggtcttgtatttgctgttttgtactatgcaatctttacgtttgcgattaagaagtttaacttgatgacgcctggtcgtgaccctaaggatgacgacgatgcggctaacaacgtgcaagtcggtaaggctgcgacggttggtggcgaagacaagtatcttcgcacagctcgtatggtttggtcagcacttggtggggatgcctcagctaaggaaaacttgacgtacctttacaactgcacgacccgtttgcgttacaagatgacggatacgtcattagctgacgttgacgctttgaagaagacacctggtgttatgggtgttaatgttttggatgatcaccaaattcacattgttatcggtccggatgtacaattcgtcgctgataacgttgaaaagatttacaacggtgaaatttcttctaagttggagaatccgttgtctgctgaagaagcaaagccggttgatgatacaccagctggtaaggaagaaaacttctttgcggttgctaacggatcattgcttcaccttgagcacgttcaagatgagacgtttgcttcaaagatgatgggtgatggtttcgctatcgaaccatctgataacaacattactgcgccattggatgctgaagtaacaatggttgcaccaacgaagcacgccatcggtttgcgtactgagagtggtttggaagtgttggttcacatggggatcaacaccgttgaaatgaacggagaaccatttgacgtgaaggtatcagttggcgataaggttaagcacggtgatttgcttgccacgatggatatcgaagcggttaaggcagcgggtaagcttgccacaacaatggttatcttcatgggcttggctgaaaatgctgaagttaaggtagatgacgaggatatctttgatggtatcggcggcaactatgttggacgcgttatcttttaatcacatataattaaggaagctcgaacgaactgttcgggcttttttactgaaagaaaagtaagcattttttgttgaacgtatgttccgtgggtggtacactcaaacatgagcgtacgggcacgattgtgcagagaaataattatatagagagatttgtttagaaggtaaaacgaatgagcttaattaatcgtgaacgaataaatgaaattcgacaggcaaatgacattcctgtccgggaattggcgaacatcggtattagccgaaaccgttactaccgttatttgaatgaagaaaacgatttgcctgctgaagggttcatttcgttgatgagtcatttgcttttgacgggtgccgagattaatacagaattggttaacgggcaagatacagttgaaggattgatgtatgagttgctagacgcaaaccgtaagcgtgatcctgagaccattaaggaagttagtcgacgtagctaccaactattccgtaacaccatggcgcgtggcttcttgcgtgtggcaagtttggcggatgtgcttcacgcacgattgattcctgatgagcatgcacaaattgcccaacagattttgattgattcatttgaagccgttaagatttggcgcgaaatggacgtggcacttttgtatccagtgattgcggaagttgagcaaaaggatgctttcaactatttgtcagttatttggcaaaaggcttggcctcacggtacgatggaacgcttaaacgcgacgacggctcgttatttaattgaactgcttaaagcagacgaatttgatttagagacatttaaacaggtagctgattggatggctaaccaagctaagagtgcgatgagctttgcttggtgggcgactgtcgttagccagttggagaaccacgagtgggatgcagtgaagcaacaagttgcaaacgctgcggccattggcatgactgatatggctgatttagccgaagagttggtaaccgtttggtatcaacgcgctgaaaataggtaaaaagaaaaggagagttgaacggcatgttcactctcctttttgtgttacttgttggcaattacttcgatgtgattgccctcaaaatcgtcgagatggaagataatgtggcgaccatcttctgattcggttgctggcttagcttgtgtgacgtagtagttaatgaagtggttttcgaccgtttccttgtgatcacgaacggttacttgaactgtaattggatcagcgtcgggctcttcttcaaaaacaattgattgttggtcgaagtagagatgacgagattcgttttcgccgaattcagttggcaaatcaaacacttcacggtaaaagcgaaccgcacgagcaacatttttgcttggaatgcgaagtggggtaaacttacgaacgcgcatttaaaaaacttccttttttattttcattatacgcgttgaccacaaaaaatcacatttttggaaaaatcgacgcttattgcctctttattactggaggtgcgaagatatgttacaaacaattaagtcagttgctgatttaggtaattacttagcaagcaagtatggggatcgcccacaggaaagttgttggctaattgcggtgaacacacaactacgggtgcttgagatacagcaggttgcgcaaggcacattggatggcgtcgcaattcacccgcgggacatctttaggcgattagtggcgttgaatgcgtatgggtttattctggttcataaccatcctagtggcaatctaaaagcgtcgttagcggatcgtctttttatgcgtcaacttgcatattgcagcaccctgatgcaggtccatttttttgactttatgattattggttcgggtgggtttgtgagtctaagagcaacaggcgagctaccaaaaatcggcctcgaaaccctgtatgatttatggacggatgctaataagttgtgatacactaaataagaaattaatgtggcgtttttatgtagtgccatacgatgaatgataataaaaattagtaaagaaaagggataaaagccgtgttttcatttggaactcgaaatgtcggaatcgacctaggaactgccaacacgttggtatacattgaaggtaagggaatcgtcttgcgcgagccatcagttgttgcgcgaaacacaaagactaacgaggttgttgctgttggtgcagcagctcgtgatatgttgggtcgtacgcctggttcaatcaaggctattcgcccaatgcgtgatggtgtaattgccgattacgaaacaactgttgcgatgttgaagtactacctaggtaaggccctaggtggtcgtggctcaaagccatacgttacaatcggtgtaccatctggtgtaacggctgttgagcgtcgtgccgttatcgatgctgcgcgtgtagctggtgcgcgtgacgcgtacgttattgaggagccattcgcagccgctgttggtgctggtttgccagttatggaaccaacgggatcaatggttgttgaccttggtggtggaacgactgatgttgccacaatttcattgggtggtatcgtatcatcacgttcaatccgtatggctggtgataagcttgatgaagcaatcatgtcatacatccgccaaaagtactcagtattgattggtgagcaaacagcagagcgtttgaagatggaagttggatcagctgatgttgaagctgctaaggacatggaaggtacaacggctcgcggtcgtgacttggtaactggtttgccaaagacaatcgacatcgaagcaactgacgtggctgaagctatcaaggatgtcattgctgaaatcatcgttgccatcaaggaaactttggaagagacgtcaccagaaattgctgctgatgttattgaccacggtatcgttttgactggtggtggtgctatgttgaagcaccttgatgaagttattgctgaagcaactaaggtgccagtattcgttgcgccagagccattggatgcagttgtcatcggtactggtgaagcattgaagtcaatcgatgttttgaagaacaactaatcaattttaacgataacgccgcaccattcggtgtggcgttatttgttagcaaaactgacgaaaggcatgtttgatatgaagaatatcttaacttcacgacgtttggttgtagcggttatcgttgcaatcgtgacaatcggtcttattgtcattagttcgcgagcacaaaactctcaaaaagaaccttccttgccaacgcgtgttgtgtccgacgtttcaggttgggtatcaagtgttgtcagttcaccggttaaggcagttagtggtggatatgaggcggtctctggattgctaaacacgtacaaagaaaatcaggcattgacggaaaaggttgacgacttggcacaagcgaaggtacaacttcaaacgttgcaagctgaaaatcgcgcattgaaggatcaattgcaaatcgaaaacacgttaacggactataaggtcgttaacgcggttgttatttcacgttcaccaagtaattggcaatcacagctaattgttaacaagggatcaaatgcaggcatcaaaaagggaatgtctgtcatgggttctggtggtttgattggtcgtgtgtctgaggtcaacacaacaaacgctaaggttgagttgttgtctgatgatagccaagtggcggatcgttttgcaatccgtgtggctaacaaggacggtgaggttgtcgatggtattgtcacaagtttcaatcaagaaaagaacttgattgtgatgggacaaattacatctgatgttgccttggaaaagggcgatcttgtaacgaccagcggtttgggtggtgtaacgccagccggactttacgttggtaaggtacaaaaaattagtcaagacgactacggcctatcaaagaagatttacatcaagccggcaacggactttaacaatattccagttgttagtgtggctattccacaacaatagcaaaaaaagacgtcacactctgcagaaacgcagggtgtgacgtctttctatttgtcttggtaatacaggacgtggcgcccgtttaaaggctgtaaatgacgattattatggtcgtagtgcacgtggaattcagctaactgttccgctgaaactgtcataggttgttctaaaacataccagtcaacgttttcagataacggtggtgtcgttagtgagccaatgtagtggtaatatgaccggttagttggtaatagatcagtgacctcacatgagaaaaccgactcatcattaatccggcttaaaatgttagcgaacgtttctgatggggcacccaattgtaaaaagacaccaataactgccaatctaccatcggcagcctcgtgcacgaaatgaatttcaccgtcatatgcctccccgtcgagggtatgctcacttggggcgtggacgtgaaattgttgcaaccggaacggacgattagcgattatcgccgtacctgtaagcccgacctctaaaccttgaccggtgtcacggacatagttggcgttgagatcgtagtacaattctaatgacgcagggtagtcaatgctgtcagcggttttgcttgtaatggcaataggtgattgcattaaaccggctgtcattgaccaagactcctgcgcatcataattgagtttttgcatgaatctagtcccttctgaagtgtctctctctcctcagaacacttttagtttatcagcagtccgaaaagttggctagtgggtttttaagagtcgtgcaataaatgtgacattttgttgacgttcgacaagtggtagggataatatagtagaagctacaaacaatcgtagtgcttaatggagaagataaatgttgaaatacgtgcacacctcatggttacatttcgttctggtgtatatcgcaatcatgctagatggggggattgcgctgtactttgcaccagtgctatttaagatgccgatgtcggccagcccatacttatcattgattgtcatgatgatgccggtactgactggcacggttacgcagatgaaggaacgtagtctatatatcgcggcgttcttgggcggcttgctatttgatattttttattctggtctaattggtatttcaatgattggattcccgctgacggtttggttagcaagcaaactccaacgttacctaccaacatcatttatgtcgtcagtggccgtctggttcgtgtcgatgagcatgtatttggtgtttgattacgctgggtttggtatcatcaatctaacgaacttgaacattccggatttcattattttccacatgttcccaacattgattattaatttgatgttgttggtcttagtttatggtctactaaattattggtaccatacaacacgtcagccggatatttcagcctacaatgttgatgatagtgacttgaatgggcgtttgccattattgaattcgaagtcacgatcacgttcaattcgttagtctagtttgaaacggttgacttacgacactaattactttaaagtaatcccataaagatttgattggacgagtagtctaacgtcggtgctaagagagttgcgcagaagctgggaagcaaccatcggcctagatgaaccacacccatgattatcgatacatcacaaaatgtatccggatcgtctcgttataggcgcgcgcctggtttaatcaggggctagagtgttggttggtaacaactaacaaaattgaggtggaaccacgatttttatcgtcctcaagtaacctatttttgggttgcttgaggacttttttattgcaggaaatggagtacaaggtatggattacatgatgcaaattatgccaagtttgctggatgggcttaagatgaccatcggtgtcttcgcattaactttaattggatcagtgccgttgggaattttggtggctttggcattgaagtcagatatcttcttgttgcgctgggtaacgaacggttatatctgggtaatgcgaggcacgccattgttgcttcaaattgtgtttgtctactatggattgagtctggctcacattgtgacattcccacgttttgaagccgcggtcatcacatttattattaactatgctgcgtacttcgctgagattttccgtggtggattacaaagcattccacaaggacaatatgatggtgcgaaggtgcttggtctaactcgctggcaaacgatgcgtaagattgtgttgccacaagtggttaagattgtgatgccatcggttggaaacgaagtggtaacgttggttaaggatacgtctttggtctatgttatcggtttgggtgacctgatgcgtgctggtaatattgcggcgtcacgtgacgttacgttggccccatatctactagtcggcttgctatatttgattttgacggcagtcgctacagtgttgcttcgtcgcatcgaaacgaatatgaactactatcgttaaggagtaaggtaaatgctagaaattaaaaacttagctaagtcatatgacacgcgcacgatttttaagaacatgaatcttacggttaacgacggtgaggttttgagtattgttggtccttcaggtatcggtaagacaacgttcttgcgaattgttgctggtttgctaccggcggatcaaggtgagttgattctgaatggtgaatcacttgatttaactggtgaacgtactggtgcgcaagttggggttatttttcaagatttcaatttgtttccacactacacggtgaaggaaaatgtgatgttggcgccacaaatggtgcacaatgagtcaaaggatgaggcggctgaaaacgcagaccgtttgctagccgacttgggtttgacagctcaagcggatcaatatccattccaattgtctggtggacaaaagcaacgtgttgctatcgcacgcgcacttgctatgaagcctggtattttggcttatgatgaaccaacatctggtttggatgcggaatcaactgagcgtgttatcgctgtgattaagcaattgcaggcgcaaggtgtgacgcaattgattgttacccacgatttgccatttgctgagactgtggctgataagacctttgattttgggacggatgttgaacgatagggggctgtcgcaatgaaaaagaagattaactggcgccgacagattatcggtaacggtattgtactagcagtgctagccttgctggttggatttgtttggtaccgcacgacgcacgcacaagacacttggcgccaaatgacggctgataaaaccgtggtggtgggcttggatgatacgtatgtgccaatgggcttccgtgacaagtctggtaagttggttggttatgatgttgatttagcgcgtgcaacgttcaaaaagctgggcctaaaggttaagttccaagcgattgactggtcaatgaaggaaactgaacttgatactggtcacatcgacatgatttggaatggttatacaattacaccagcccgtgctaagaaagttgccttctcagtgccataccacaatgattcccaagtgttggtgacgatgcaacgtgatcacattaatacgattaaggatatggctgggaagacgctggctgcacaaactggttcagctggactaacgttgtttaacgataagccaaaggtgttgaagagcttccttgggtcagcaccggtgcaatatgacacctttgataaggcgttgaacgacttgcaagttggccgagtgaatgcggtattgattgattcagactacgctcgttattacgtagcgcacgagtcaaacccagccgagttcaaggtcatcaagactggttacggacaagacgcttatggtatcggtttccgtaagggtgatgtgacgttgcgcgaaaaggtaaacggtgtgattaacgagttcaagaaggacggcacactggataagatttctgagcgctactttggcacgaagaacgcagattaattgatttaggagacaacctcatgatggggttgtcttttttgtttgcgcgttagtggtgacacaaattacgaacaataattgcttaacaccatcaaccaaataattccaaccgggttcgaaacgattcaacaacttttggagagcgcagttaacgtttgaaaaacgaatgttcggccgaatgaaattttaaccagctgaaagtgggttgtatcaaaatggtttgtccgtaagcttagttgtgtaaccaaatcacttcggatggctaaaaggagaagttttaatcatgaagacgacgtttgacacagttgctgatgcattgaccgtattgcgccaagggggcgttatcatcttggcggatgatgaaagccgtgagaatgaaggtgatcttgtcgcacttgcccaagatattacgccagaaacggttcacatgatgttgcgtgaggcggccggtttgatgtgcacgccagttgggcctgaaattgcggaacggttgggatttacggatatggtggctgagtcaacagacccacatcaaacgccattcacatacacggttgatggtacatttgaagccactggtgtaacaactggtgtgtcagcgatggatcgtgcggcaacgattcgacaaatcgccaacccaactgccacgcgtgccgatttcaatgcacctggtcacacacaaccgttgacggccaaggaaggcggtttggcaacgcgtattggtcacacagaagccgccgttgatttggcacgcttggttggatcagaaccggccgccgttattattgaagtcttgaaggaagatggtacgatggctcgtcgtgatgatttgtttgagatgtctgaacgattggatatcccattcattacaatcgaacaaattagtgcttacatgacggtgccagctgtctaattaaaatgatgagaggttcggattcacatccgaacctctttttttgttaaaagcatcaggttaaacgagaatgtttgtttaattttatgaagaaaacaattaaacacgaatatttatttttcatttgtattactttgtgaataaaaactgtacatttagaatgaatggtggttaaatcatcttgtaaatacgaacgaaaagaatggggagaagataatgaatcgtgtttcagtaataatgggatcgatatcagattggccaacgatgaaagaagcggtggcgattttggagcaatttgaggtaacagtcgaaacacatatcatttcagcccatcgtatgccaactgagatggcgacgtatgcggcgaatgctcgcgaagccggggtggacgtaatcattgctggcgctggtggggcggcgcatttacccgggatggtcgctgcgcaaactaccttgcctgttatcggtgtaccgatgaagacgaaagcactcaatggtgttgattcattattgagtatcgtccaaatgccagcgggtgtgccggttggaacagtcgccattggggaggctggggctaaaaatgctgcgtattacgcccttcaaatgctgtcaatcacaaaccagacgttggcgacacaattggagacattccgtgagcaacaagcacaaaaagcacgtgagagtgaggagcagttacatgactaaacccattttgccaccggccacacttggaattgttggtggcggacaacttggccaaatgatggccttagcggctaagccaatgggatatcgcgtggtggtgctggacccacagattaacgcaccagctgcccagattgcggaccaacagttggttgcaaattacgatgacgaatctgcgctacgcaatttggcggatatcgccgatgtcattacgtatgaatttgaaaatgtcagtcaagaagcgttggccaatgcagtgccagctaagcagttgccgcaaggtacgcaactgctacatatcacggctaaccgcttgcgtgaaaaaacatttatcgcggatttgggattgccagttgcgccatttgcggccgtcgataatgtcgttgcgttggatgcgagttgccataaggtatcattaccagcaatcctgaaaactgttgaaggcggttatgacggtcacggtcagtgggatattccaaatcaggaagctttagcaaacttactggctcattgggatgtcccagttaatacaccaatgattttggaaaaacagataacgtttgatcgcgagctcagcgtgatggttgcccgagatatctcaggtgacattaggacttggccagtgacggttaatgagcatcaaaatcacattttgcatgtgtcagctgcaccagcgtcactatcagataagattgctgacgagattgcgcacatcgccaaaacattagcgaatgcgttgaacctcgttggcgtgcttggcattgagatgtttgtggctggtgatcaggtatatgtaaacgaattagcaccgcgcccgcacaattcaggtcacttcacaattgaagcaaccaatgtttcacaatttgaaggacatgtgcgtagcgtgttgggattgccgattccggaaattaagcagtgggcaccagcaatgatgttgaatttattaggggatgacatcaatcgtgctcgcagggagttggtagaccatcctgagtggcatatacatgattacggcaaggatgaggttaagccgggacgtaagatggggcatatcaccgtgacaggattacgagaaatgaaggcattacgtgcatgggggcatcaaaagggatgattacacaagaagcattgctaacaacgggtaaagcgaaggccgtatacgaaactagcgatcctaaaattctttggttgcatagtctggatcaagcgactgcgttgaacggtaagcaaaaagaacatattccggataaaggacgtttgacgacacaaattagtggcttactattcgaaatgctgaatcaagctggtattaagacacattatttgtcgccagttgatgagacggatattttggttgcgcgtttgacgatgttgccaattgaggtggttgttcgaaattttgcggcgggtcattttgcgtcacgttttgatgttgaaccgatgacaccactggttccagtggttaatgaatattactacaagcgtgatgatttggatgatccagcgctgaacgcttcacaagcggtggcattaaagttagcaacaccggcgcagttggcagagatttctgacataacggcgcgtgtcaaccaattgctgaccgagaagtttaaaacaatcgggattacgctactcgatttcaaaattgaatttggtttagacgaccaaggtgcattggtcttgggagatgaactatcaccagataacatgcgcttgattgacgatgcaactggcgcttcgcttgataaggatgttttccgccgcggagaaggcgatttgcgtgatggatatgaaattgtattgcaccgtttgaatgaaacaaaaggagaataacccatgtttttagctaagatttacgttacatacaagccctcaattcttgatccacaaggcgaggttatcaaatcagcgttgcatcgcatgaattttgaaacggtcgaaactgtgacgcaaggtaagtattttgaagtcacaatgagcaatgctgatgaggcagcagcctacgatgaagcggtggcctatacggaagcacttctgattaacccaaatactgaaacgtatcgaattgacctacttaagtcagtggaggcgtaaacatgaaagcagcagtggttcgttttccaggctctaattgtgattttgatatgtattatgccttacaagacttcggtgtcgacgtcgcatttgtcgatgaaaaagcgacgtcactagcgggttttgatgcagtctttctgccgggtggcttttcatatggcgactatcttcgaactggggcggttgcacgctttgcacctgtgatggacgccgttcgagcagcagctgatgaccacaaattagtggttggtatctgcaacggcttccaaattttgactgaagccggtttattgccaggacaactcatgatgaatgagcatccaggtttcatttgcgatgaagtaccacttgaaattgtgaatcagacatcacgcttctcaaaggcatatgaaacgcaaacagtgaccttgccagttgcccacggtgaaggtcgttatgttgctgatgaagcgacattagaagcgttacgcgacaataaccaaattatctttaagtatcgaacaaatgttaacggttcgatggatcaaattgccggcatttcaaaccgaaatggtaatgtattcggcatgatgccacacccagagcgagcagtcgatgcattgcttggtaacacggatggtcaggcatttttcaaaagtttgttaaccccaattatgacggaggcgttggtaaccgaatgacaacagcaacaaccacagcaacaaccacatatgaaccaaccgcagaaatggttcgtgatgaaaaaatttatcttgcgtggggtctaacggaggcagagtacgacttgattgtcgccaagttggatcgactaccaaattacacagaagctggcttgttttccgccatgtggtcagagcacgtttcgtataaaaagtctaagccggttctacgcacgttttggtcacgtaatgaacgtgtgttacaagggccaggtgaaggtgccggtatcttagatattggtgatggccaagcagttgttttcaaggcagaatctcacaatcacccatcagctgttgaaccttatgaaggggctgccacgggggttggcggtattctacgcgatattttctcaatgggcgcgcaaccgattgctgtcttggatagtttgcgtttcggtgagctgaacaacgccacaactaagcatctattagatggtgtaattgacggtattgccggctatggaaatgccattggtattccaacggttggtggtgaaatcgggtttgatgctgtttatcaaggtaatccactagttaacgtgatggccgttggtgtgattgatcaagccgccatgcaagttgggcgtgctgaaggcgttggtaatacggtcatgtatgtcggagctaaaactggtcgtgatgggattcatggtgcgacttttgcgtcagccgaattttcttctgatgaagatcaaaatcgctcagcggtccaagttggtgatccattcatggaaaagttggtcatggatgccacattaaaggccattcgtgaacacggtgacgttattgtcggggtgcaagacatgggtgcagccggtcttgtatcatcttcagctgagatggccggtaaggctggtatggggatgcaattgaatttggatcctgtgccagaacgtgaagctggcatgacgccatatgaactcatgttgtcagaatctcaagaacgtatgctgttggtggtggctgctggtcacgaagccgaagtgcaagcggtctttgaggacgctggcctcgatgcggttgccgttgggacggtcacagatactggccgttacgaattgctttggcatggtgacgtggcagcaaatgtgcctgttgattttctgacgacggcaccgaaacaagagatgccacaagcaacgccaactcgtctaaacgaaccaagcgctgattttgtacccggcactcttgatggtgcaacaacactaactgagttgttgcaacaaccaacaatcgcgtctaaagcatcgttgttccgtcattttgacagcatggtgcgggctgatacggttgtgaagcctggtggtgacgctgctgtggttcgcttgcgcggtaccaagaaagcgttggcgatgacaactgacgtgaatagtcgtttcacatatcttgatccttatattggtggtcaactagcggtggttgaagctgcaggtaatgtggttgcaactggtgcacaaccaatcggcattacagattgcttgaattttggtaatccagacgacccagaaatttactatgagcttgcgcagtcggtggccggcatcaatcaaatggccaaacagttgaacacgccagttatttccgggaacgtgtcactttataacgaaactgatggacaggcgatttacccaacgccaatgattggcatggttggtttgcatgaggacgtgaagatgattacgaccatcagttttaaaaatgcgggtgatgttatttacgtccttggtgaaacagctgccgactttaatggatcagaattacaaaagatggtcactggcgatgtttctggtcgtttacgtggttttgacatgacgaaaattcaaacaacacaagcaaagttgttggacgcgattgcggctgatttagttgctagtgcccacgacattgctgaaggtggcttgggagttgcattagcagaaagtacgtttaagacgccatttggagcatcgatgcagtggcaagtgccgacagcttggttgtttagtgaaacacctggccgttttgtggtatcggtgcctgaagcaaacgtcgcagtatttgaacaattgatgggtgacaccgccacaaagcttggtgtggttactgcaggtgacacgattcaaatgaacaccgaagcagatgaattaaacctatcaaaaacaacattgcaagagaactatgaggaggccatcacatggcaacgcaaccagtgagtgagagtcgatcactgaatgaagaatgtggcatttttggtgtctgggggcatcagtcagctgctgatttgacctactatgggttgcacgctttgcaacaccgtgggcaagaaggcgctgggattgttgctaataagcaagggcatctgtggcaagaacgtggactggggttgttgagcgatgtgttcagtgacccaagtcgcttgcaacattcgcaaggacaatcagcgattggtcacgtgcgatacgcaacggctggttcagctggaattgaaaatattcaaccgttgatggtgaatttttcggatatgcaattatcacttgcacacaacggtaacatcacaaatgccttgtcattacgtcgatcattggagcaaaacggcgcgattttccaatcgtcatcagatacggaagtgctattacatttgattcgccgttcaacggcgtcaacgttctatgacaaattgaaggatgctttgcgtacagtgcgcggtggctttgcttttttgctactaacaccaactgctatgtatgcagcgctagacccgcacggcttccgtccgtttgtggtcggacaattaccagatggtcaatatattgtgaccagtgaaacggcggctttgaatgcggttggtgcgacgtttatccgtgatgtacaaccgggtgagttgatcacgattgatcaacacggtttgaagattgatcactacacgactaacactgatttgcatattgatgcgatggaatacatttactttgcacgaccagattcagatatctacggggtgaatgtccatacggctcgtaagcggatggggcgtttgttggccgctgaacaaccggtcgatgctgatttggtggtaggcgtcccaaattcttcattgtcagctgccatgggttttgcagaagcagctggtttacctaacgaaatgggattggttaagaatcaatacattgctcgaacgtttatcgaaccaacccaagaacgtcgcgaacgcgcggtgcgtatgaagttgagcgccgtgccgtcagttgtggcaggtaagcgcgtggtcttggttgatgattcgattgtccgagggacgacatctaagtttatcgtgcggatgctacgtgaagctggcgcgagtgaggttcatattcgaattgcttcgccagctttcaagtatccatcattctatggtgtcgatatgcagacaacagaagagttgttggccgctaattacacgatgagtgaaatgcaagagatgttgggcgttgattcattagcctttctgtcagttgacgggttggttgaagcgattgacctgccatacgaaggaaacggcaccggattgacgacggcctattttgacggccattatccatcgccgatttatgattatgagccaactttggcagatgcgaaggcagcgggccaggttgattttcaacctgaacccacgacgacttaccatccgaatcaggtggcgtcgattcaaaaacaacaattacaagatgcacagacagttggttaattcattgggggagttatgacgaatcaaaatgcatatgcgaatgcaggcgttgatgttgccgctggtgaacaagccgtcgatttgatgggcaacgccgtagcagcaacttatacaccgcaagtccttggtggcattggtggctttggggcagcgtttgccttgggaaatacgtatcgtgatccggttttgatttcaggaacggacggcgttggcacaaagttattgctcgcgattgcggccgacaagcacgatacgattggccaagatttggtggcaatggtgatgaacgatattctggcacaaggtgctaagccactctttctcctcgattatctggcgattgctaagatgacgccggagaaagttgcgacaatcgtgacgggaattgccaaggcaacgcaagccgtcggtgcagctttgattggtggtgaatcagctgagttgccagggatgtatgcccctaaccactatgatttggcagcgttcggtgtcggggttgttgaacgggacgagatgttgaacccggccgatgtggtcgcgggggatgtgttgattggtttgccatctagtggcattcattccaatggctacacgttagtacgcgaagtctttggtatcaacgaagaatcagattttgtgaaattgccaacgcgcttacaagaggcattgctaaagccgaccactttgtacgcaccagctatcctgcctttgctggctgaaaagatgattgtcagcatggcacatattacgggtggcggtatcgttggcaatctgccccgtgcgtacggtgagcaggtagcggcaaacttacattggggctcatggccaatgttaccgattttcacggaaattcagatgcgtgggagtttggcgcaagctgacatgcttgagacgtttaatcttggcttaggtatgattttgattgtgaaagcgaaccaggtcgacgcaaccatgacaatgttccaagatgccgaacaaccggcgtttattattggtgaaatggtcgcgcgagaatcagaaccaatcatctggcaaggagagcaaccatggtaaaaaagccgaaacttgccgtctttgcgtcaggtactggctcgaatttagcagcgttgctgaaagcagcccaagccgatacactcggcggtgacatcgtgcgggttgtgattgatcgcaaaagcgctggggcaattgccattgctgaggcggctaatattccggtattgcaaattcgctacccggctttcgagacacgagaggcggcagagcaagagattgttaaaacgctagtggcggatggtgtgactggcattctattagctggttatatgcgtattttgacgccgtatattgtccaagcgtttgaacaacgcatcttaaatattcatccggcactactacctagttttcctggcaataacgcgattgaagatgcctggaatgctggtgttaaagtgactggcgtgacgattcattatgtcgatacgggggttgactcagggcaaattattgcgcagacgccagtccttatttcagaagacgaaacaattgatgaactgactgaacgtattcacgatgcggaacatcatttgtatccagaaactgttgcaaagttaattaaagaaggagtttttcaagcatgacacgagcactactaagcgtttcagataagaccggtttggcggattttgccaagggactagttgcattgggctttgagttggtttcgactggtgggacattggcaacattgcaggaagctgatttgccagtgacaccaattgatgaggtaacgcaattccctgaaatgctcgatggacgggtgaagacattgcacccacgtgtccatgctggcttgctagccaagcgtgacgatccagaccatatggcaacgttggcagaacatgatattacgccaattgatttggtggtggtgaatttgtatccgttcaaggaaacaatccaaaagccaggcgtgacattggccgatgccatcgagaacattgatattggtggcccatcaatgctacgttcagcggcgaaaaactatgcagcggttttgccggtcgttgatccagctgactatgatgctgtgcttgaaaacctacaaaataacacaatcgatgacgcattccgtcgtcaacttggtgccaaggttttccgtcacacagctgcttatgatgcgttgattgctgactacttaacggatgaagaattcccagcacaaaagacggtgacgtatgagttatttgagccattgcgttacggtgaaaatagtcaccaacaagcagcagcgtaccgcgacgcattgccaacggattattcagttctttctgctgatattttgcacggcaagcaattgtcatataacaatattcgtgacgccgatgctgccttgcgcatcattgccgagtttgatgagccaaccgttgtgacggttaagcacatgaatccagctggtattggacaaggaacgacgattgaggccgcttgggatgctgcctttgctgctgatgatatctctatttttggtggcattgtcgcattgaaccgtgaagtcgatttggcaactgcagaaaagatgcaccaaattttcttggaaattattattgcgccaagctttacaccggaagcatacgacgtattggctaagaagaagaatttgcgtttgttgacagtgccgttcacaacggatgtgccacaagcggttgaattgaccgcggttcttggtggcgtcgtgatgcaagaacgtgacttggtatctgaaacgttagctgatttcgaagtggttggtgatgtgcaaccaacggcagcgcaacttgaagcgatgatctttgcacaaaaggctgtcaagcacgtgaagtcaaacgcaattgtcgtggcccaaaaaggacagacacttggtgtgggtgccgggcaacctaatcgcattgattcagtcaagatggcgattgcgaaggctagtgaaaagccaggctttggcaatgcggtactggcatcagatgcctttttcccaatggatgattcagtaacgtacgcggctgaacatggcattacggctgtcgttgaacccggtggatcaattaaggatcaggcatcaatcgataaggcaaatgaattgggtattgcgttggtattttctggcacacgccactttaagcactaggagagaaacatggcgaaggtgatggtaattgggtccggggcccgtgagcatgcattagcagaaacgtttttgcgaagcgctgcagttgaagaggtggttgtggtgcccgataatgctgggatgcagtcagtaggaattcgaacaattaatcacgatatgatggatgtcgccggattacgtgacctagcagaacaagaagcgattgatttgacctttgttgggtcagaggcaccgttgattgcaggcgtggttgatagctttcaagaagctggtttaaagattttcggtcccacgaaacaagcggctcagttggaaggctcaaagcagtttgccaaggatgttatggcccaagcaggcgtgccaacggcgacatcggtaatggttactgatgaagttcgtgcacgacaagcgttaaaaagcttcgacttgccacttgtgattaagcaagatgggttggctgcgggtaagggtgtggtgatttgccgtgaccgtgaagatgctgaaacgatgattcagctcgcgtatgaacatcaagttgatgcaccgttggtcattgagtcctacatggctggggttgaattttcaatttttagcctggtgggttctaatggggtggtttacgcaccaattgcacaagatcacaagcgccggtttgataatgaccaagggcttaacaccggtggaatgggtgcttattcacctgttcgttgggtatcagataatcttgttcaagaggctattgaaaccctagttttgccaacattgacgacaatggctgataatgacatgccgtttacaggtgtcttatacactggcgtcatgttgactgatgatgggcccaaagttgttgaatataacgtccgctttggcgatccagaagcccaagttgttttgccacagctacaaagtgatttttatgaacttattttggcattattggctggtgaacaaccagaggcaacctggcaacaagacgatgtttatgctggcgtggtgttggtgaacccgagttatcctgcgccaacaactgagcatatcgttctaccatcattttcaatggccgacatcaacacattttatgcgggcgtgacgcgaaatgatgataaactaataagtaatggtggtcgtatcgccacggttgttggtcatgcagcgacggcgtcacaagcgcaagagacagtgtatgaggcaattgatgcgacacaaacaacattagcttatcgccatgatattggctatcaggcggttcgagaagaaaataaggtggtatctggggatgcaaactgatattgagattgcacaagcggcagaagtttggccaattgaaaaaattgctgagaaggctggtttaacagcagccgagtgggagccatatgggcgtgataaggccaagatttccgtcgatgaatcagcgcgccaagatggacttggcaagttgattttggtgacgtcaatcaatccaacgcctgctggtgaaggtaagtcaacggtgacggttggtttggccgatgcgctgagcttggccggtaagaagacgatggttgcgttgcgtgaaccatcgcttggaccggtcatgggcttgaagggtggcgccactggcggtgggtatgcccaggttgtcccaatggctgacattaacttgcactttacgggtgatttccacgctttgacgagtgcccacaacacgttggcagctgttattgataacagcatttatcaggggaaccccttgaacattgacccacgtcgcttgctttggaagcgtgctttggatgttaatgatcgcgctttgcgtcacattacaattggtttgggtggtccaacttctggggtgccacgtgaagacggctttgatatcacggttgcttctgaattgatggcgattttgacattgtcacatgatttgatggatatgaaggcgcgtattgaacgcatcgttatcggttacacgtacgacaaggaacccgtgactgttaaggatttgggcgttgccggcgcattaacgacattgttgaaggatgcgattaagccaaacttggtgcaaacgcttgcccacacgccaaccttgattcacggtggtccgtttgccaatattgcacaagggactaactcaattcgtgcaactaagacagccttgcaattggctgactatgttgtcactgaagctggttttggggccgacttgggtggtgagaagttcttggacttcaaggtgccgttgttgggtaagacaccagacgcaattgtcatcgtggcaacggtacgtgcattgaagatgcacggtggtttgcctaagacggaattgacagaacctaatttggacgcgttgtcagccggtttggctaacttgggacaacacttgaagagcatgtcacgttacggcgtgccggttgttgttgcggtgaaccgctttgtgagtgatacaaccgaagaaattgaaatggttgaaaactacgttcgtgagcgtggggctgaagcctacatggccgatgtttgggcgcaaggtggtgctggtgcaccagagttggcccaagctgtcattgccgctaccgagcaagaaagtcaattcacgtcattgtatgcgcctgaagatgatgccgtaacgaagatcgagaagattgtacaaacgatttacggtggtgccggggttgaattgtcagataaggctgccaagcagttgcgtgagttcgcaaagcgtggctgggacaagatgccagttatcatggcgaagacgcagtactcattgagtgacgatgcaaagaagttgggtgcaccaacggactttaagattcatgtgcgcgaatttgtgcctaagttgggggctggtttcttggttgcgttgactggttcaattttgacgatgccaggcttgccaagccatccagcggcatacgacattgatattgatgagaacggtcaaattactggcttgttctaaacagttataaatgaaaaaagccgatcttaattgatcggctttttgtatgcaatgatgttgttgtaggtaccggttttaatgaagccaagtttttctaagatgcgttgtgacgcaacattatcagcgaatgtttcggccaataatgttgttggtgtcggtaacgctgcgatgaaacttcgtaaggcttgggtcatgatgccgtgacctgcaaaacggttatctaagaaataggcgaggtcatactcattgggaataaaatcgccggttttagagacgcgtgcgtaggtgatgatgctaccaattatctgttctttataaacaatggccgcttggaacggttgatataaatctgtttcaaacatcattcgccgttgctgtgtgtccacatcgggtagtccggcaccttgcataatttcaggttgtacgattaattgttcataagcatcaaaatctgtcgattgccaggagcgtaatgtgattttagccatattttagaaccatgaattactgaatccgttcatccggtatgcacgtggggcgcttttaccgtaaaactgggcagcaagttgtagccaggcgagggccagtagccagccggcaattgcaccggataacgtgtaattgtttaataggatagttccggtaaaggttaataaccatccagcgacaatcacgacctgaccaactatccgatagaagattgtttttagttcaggaatgacgattttcgccagaaaaaaatagagtaaggttgcgaaaaaaatcgtatgagctggatactctgttttttgaccggcaacctggtggttaaatattaaagaaaagacattaacaattagccagccaagtaaggtcgttaacaaaatccaggccgctgggattctaaacttcaacccccacaataaaaatatgaagatgaaaattaatagcgcaaataatatgccgtggctaaacatgacgaacggcgttgttaggtgcaacaaagcggcaggtgtgaaattggctagtaaattttgttcagcggcgtcaatcagtgcgataaatgatgatttaataaacacactaattgtaaaaattagaaaagccaagctactaataatgaagatcattagccggcttttagagggattgattatcataataatcgacactcctttaacaaccaatctggttaacgaatttgtatatatcgtatcattacataatcaaaaacgggtatgatttgatttgttgtttaagcagtcattaagatgattttggtactaaaagatatggttgacgagagataggaacttccctataatgaaaatcataaattaaatatgacatagaggtcgcaaccaacatgagtgattaaccaagtcggcagacaaggcggttgatttaaaggggcggttgccgaaatgtgttttcacggcggtgaaacatgttggtccttacgtgaacaacgggaggactgtcgcagcaaaatttgtcggctgcggagcgctatcgacaacactaatgatttcaaatgaggtccctagtttatgcgatggtatagactggggactttttcgttctcatgagtgcgattaggcctctctatataggaggaattatgtcagataatcaacagaatcaagggacgctgaagcgcacgatgaagacgcgtcacctttcaatgattgccctcggtgggacaatcggaactggtttgttcgttgcctcaggtgcaacggttgcacaagctggaccatttggagcgctgactgcttatgcggttatcggtttgatggtttacttcttgatgaccagtttgggtgagatggcaacgtacatgccagtttcgggttcattctcaacattcgcagaccgtttcgttgatcctgcttttggatttgccatgggttggaattattggtttaattgggcaattacggttgcggtagaagcagcgacggttggggtggtcatgggctactggttgccaaacgtgccaagttggatttggtcagcgctagtcttgattttgattacggtcatcaacttgatgtcagcaaagtcatacgctgagactgaattctggatggcgacgattaaggttgttgctgttgttgcgttcttggtaattggtgtggcaacgatcttcggtatcatggcttatcacccggatgtaccacgtaacttgtcagctggtggtaaccacggattcgtcggtggtgttggtggtatgttggccgtcttcatggtggctggtttctcattccaaggaactgaaatggttggtattacggctggtgagtcagaaacaccagaaacgtcagtaccaacggctatcaagcaagtgttctggcgtatccttttgttctacatccttgccatcttcattattggggcattgatttactacaaggatccaaacttgctacgttcaagcgaaacgaacattgcagtttcaccatttacattggtctttaagcaagccggtttggctgcagcggcatcaattatgaatgctgttatcttgacgtcagttatttcttcagctaactcaggtgtttacgcctcaacgcgtatgttgtacgccatggctgttgaaggaaaggcacctaagctattcgcacgcgttaacatcaacacaggtattccagtgccagctttgttggcaacggttgccgtcggattgttgacgtttgtcacatctgttttcggacctggtatctactactacttggtggctgcttcaggtttgactggattcatcgcttggattggtatcgcaatttcacactatcgtttccgtcgtgcctttgtcgcacaaggccgtgatgtgaagaagcttcgctaccatgctaagtggttcccagttggtccgattttggcattggttttgtcaatcgtcgttgtcgttggacaagacttggcatcattccaaggaccgatttcacactggaactggtcaggaattatcacaacgtacatgtcactaccattgtttattggcttgtaccttggatacaagattaagcacaagacaaagttgcgtaagttgacggaagttgatttggatacggacgcacgacaataataaattgttcaaaaacacacaagcaataagcttgtgtgttttttgtttgaatattggaacagataacaaacaaaaattgtgtacaaaaaaagtgaaaaatagtacaattaatgtcagttagatagatacactatcaacacaaaacgaaggagatttttcagatcatgaagaagaccaagattgtttcaacgcttggaccagctagttctgacgtcgagactattactaagttgatcgagtcaggtgcaaacgttgtacgtttcaacttctcacacggagaccacgaagagcacttgggtcgtatgaacgctgtgcgtgaagccgagaagatttcaggtaagactgtaggattcttgttggacactaagggtgccgaaatccgtacgactgttcaagagccaggtaagattgagttcaacatcggtgatgttgttcgcatctcaatggatgcttctcttgaaggtactaaggaaaaggttgccgtaacttaccctggtttgttcgacgacgttaaggttggcggacacgttttgttcgacgacggtaagatcgacatgttgatcactgaaaaggacgaagctaaccgcgaattggttactgaagttcaaaaccacggtttgttgggatcacgtaagggtgttaacgcacctggtgtttcaatcaacttgccaggtatcactgaaaaggatgccgatgacatccgcttcggtttggaacaaggtatccaatacatcgccgcttcattcgtacgtaagccttcagacgttgaagacatccgtgctttgttggtagaagctggtaaggaagatgttatgatcttccctaagatcgaatcacaagaaggtatcgacaactttgccgaaatcttgaaggtttctgatggtttgatgattgctcgtggagacatgggtgttgaaattccagcagaaaacgttcctttggtacaaaaggacttgatccgcatgatgaacgctgccggtaagccagttatcactgctactgacatgttggactcaatgcaagagaacccacgcccaacgcgtgccgaagcttccgacgttgccaacgccgtatttgacggaactgacgctactatgttgtcaggtgagtcagctaacggtgcttacccagttgctgctgttgctactatggcacgcatcgacgagaaggctgaaactgctttggcagcaaacggccgtcacgtaaacgacttcgacgcatcagacgttactgaatcagttgctgctgctgttgctacggctgcagaaaacttgaacgttaaggctatcgttgccgcaacgacttcaggttacacggcaaagatgatctcaaagtaccgtcctaacgctgacatcttggcattgacgttcgacgagcgtgtacaacgttcattgacgatctactggggtgttcaaccaatgatctcagaagcagtggacaacactgatgctttgatcgaattggctaagaaggaagttgttgctgcaggtttggcagaaaagggtgatactatcatcgttactgcaggtattcctgttacgacttcaggtacgactaacttgatgacgatcgttacggtcgactaattattagttgttaattaagaacgagagatacaactgtatctctcgtttttttgtgcaactttatgttattctgttgttaagactataacgaagtgatgaggaagtgctgatgagttggcaagaaataattgttgagacacaaactgaggctgttgaagccgtcagcaacattttgatggaagccggagcagaaggtatccaaatcgatgacgcggctgatgtgaacagctacgagcctgccgatgccactgtgtgggttgactgggatgtggttgaacaccgtgagtcaggtgcgacggttgctggatattttgcagaagatgttaatttgcccgaagttatcaatgatgtacaaatgcgcgtgaaccaattggcgtcatttggacttgatgcaacaccaggtaaagtgacgaccagtgctgttaaggacgaagattgggcaacggaatggcaaaagtattaccacccagttcgcgtgacacgtcatttgacggttgtgcctaagtgggaagagtaccaaccggcccaagaaggtgaaaaggtaatcgtacttgacccaggaatggcctttggaactggaacgcacccaacgacgcgtttgatgatgcaagcgcttgaaattgttgtacgtggtggtgagcgtttgcttgacgttggaactggttcgggtgttctgggaattgcggcgaagttgttgggtgctgacaaagtacttggtactgatatcgatgaagtggctgtacgctcagcacaaggtaatttggacttgaacccggttgcctcagatatccaagtaatggcaagtgacttgctaagtgacgtgccagcgcaagaatttgatattgttgtggctaacatgttggctgaagtgcttgtgccattgattccacaagttgatagcgttctgcgtcctggtggtaagttcttgttgtcaggtatttatgaagacaaggcccaaacgattatcgcgaagttggaagaaaacggttatgcacttgatgagacgatgaagcttggtgaatggtatggtttgattgctcaccgtaaaagcgaggacgagtaatgcaacgttattttttgactgaagcgccaaccggtcaagaatttgtgctaccagaagatgttcagcatcatttgatgacggttcttcgtggtaaagagggcacgcaggcagaatttgtgtatcccgatcaacaaacgatggtagtggctgaagtgattcgtgttgacgatgaaacgacaacaatgcgcgtagttgaagaagtgacaaccgatgttgaattgccggtggagacaacaatcatccttggtctagctaagggtgataagcctgaattggtggttcaaaaggcaactgagttaggggttcaccacgtgattatcgtggagacagattggtcagtcgtccattgggggatgaaaggcgataaaaagttggcacgtttgcaaaagattgcccaaggcgcagctgaacaatcacaccgtttgcgtgtgccggatgtaacgtacgttgaaaaactacgtgatttggtgctacctgatgatatggttaaaattgttgcctgggaagagagtgctaagcagggcgaaacagcacaactggtggctcagtttagtcgcttgaatccaggtgataaaatcgcctttttggttggacctgaaggtggtttaaaggaaagtgagttagacttgttaacgaagacgtttggctttgtgccagcgggacttggtccacgtattttgcgagccgagacagcaccgctttatgcgttgagcgcactgagttacgcactggagttagcacgttagaatttttaaggttaacatcgttgcagggatgttaaaaggggaattgatatgaaacgtttgaaagaagcgtgggattggcggttctggatttggatgccaatcttggggtggttagtgccgtttgcaattaacgaatcaccgttgacagcgaatgttaagattattttttcattgtttgtggcaaacatgattttcagtgccatcgcgggagctttcttgcgtaagcgtggtgctttctggtacttgatgtttgtgtggccactggtattcttagtatcagtctggctacaattaaactcaccgatgtatggctactatttggcagctctttatttcgtcattgagttgttcgcctttacccgcggacaagaagaagaagtcgacttcgaggatcaaattccagttgatggcggtttccgcgaaatttaaatcacaaaaacgcgaccttggtttcgaggtcgcgtttttttgtggtctgaagcctgagtggggattgtgcccaattacaacgaaagtgatggcggctgttaggtcgtgttgcttgggtcggtggatatgtcgcccatttttggacaaattcccaccactttccaccacctaatcttcccacccactgtcccccacctcccaccatcttcataagtaaggtgttaaccgttggtatatcaagaatttgaccttataaccttaaaaaattcttcattttctaaagttattcgaaaacttgtaaagtgactgttaaaaaggagcgttaagcccggtgtaataggcttttgaaccctaaaatacaccatatatcccagtggtagaacgtgggggtaggtggtggaaggtgggagattgtggtaaattaaatgtattgaaatgtcgactattctcaatacgccacagcacctgaaattgctgaataaaatgaaagggggtatcgccgatgttcatgggaacttaccaacacacgttggatactaagaaccggttgattatccccgcaaaattccgtaatcagttgggtgaatcctttgtgattacacgttggatggatcattcactacgtgcttacacaatgcaaggctgggaagatttttcaactaagattaacgcattgccagaaacgaatgccaaggcgcgccaatttaagcgttttgtcttcggtggtgcgacagaagttgaattcgacaagcaaggtcgtgtgaacctatcaccaaccttgcgtgaatacgcaaatatcgataaggatgtcacggtctttggtttgggtgatgatacattcgaactttggagtgccgagaagtggcaagcttatgaagaagaaactgcagagaattttgatgacattgctgatgggttggaagatttaggcttctaacggcaatggtttgagacaaactagaaaggtcgaacaggcaattacatatgacggagttcaatcacgtaaccgtattgcttaacgaagcaattgataatttaaatgttaagccagacggaacatatgttgatgcaacgttgggtggcggtggtcattcacagttgttagcgagtcgtttgacgaccggaaagctttggtcatttgatcaagacattacggcaattaactataataaagaacatttggctactgagttggctgaaggcaaggtcgctttcattcaaaacaatttccgcaatttgcgcgatgcacttgctgaagttggcgtaacggaaattgatggtatcgtttacgatttgggtgtttcatcaccgcaattcgatgatggacaacgtggcttttcatataactatgatgccccacttgatatgcgaatgaatcaatcacaagaattgacggcgcgtacagtagtgaatgagtgggatttccacgacttactacgtatcttgtcacgttacggtgaagaaaaattcgctaagcaaattgctcgtgcgattgaacgccaacgtgaaattcaaccaatcgaaacaacgtttgaattggttgaagtcatcaagtcagcaattcctgcagcggctcgccgaacgggtggtcatccggccaagcgttcattccaagccattcgaattgccgtgaatgatgaattgggtgtggttgaagaatcactcgcacaagctttggatatgttgaaggttggtggtcgcatttcggtcatcactttccattcacttgaagatcgcctagttaagacgatgtttaaggaaaagacggcagttcctgaattgccagctggcttgccaatcattccggatgagatgcaacctgattataaactcgtgacgcgtaagccaatcttaccttcagaagaagaaatggctaacaatcaccgcgctcattcagcaaagttgcgcgtcatcgaacgactacgatagcataggccgcccatgatggacggtgaagaaaggatctgaacatcatggatgcaatgccaaattacacgcacacaacgtcacctcgcaaagttgatcaaccacaacaacgcccacgcgttcgtgtcgttaagcataagctagaaaggccgggctttaacgctatcgatatcgccttttgcgtggcgactgctttcgtagttgtctttatggcgatggttgtcgtacacacgtcaaaccgagcagcaacagcaaactcacaattggcgacaacgtcagcttcccttgaaaaggtacgtaatcaaaacaatgatttgaagcaagaagtaagtgatttgacgagcccaagtcgtttgaacgatattgcggctaagaacggattgacacttcaaaaccaaaacataaggaacgtgaagtagcatggtgaagaaacagcggatgccaaaacgtaaccaatcggataaaaacagtcgtattacaggccttgtgctagtaagtactatgttactgattttggttgtgttgggggtccgtttttctaatgttgccatcacaaaagatgtgaaggggcataagttaaacgaagccgctcaactcatttatcgaagtcagaacacggtccaacccaaacgtggggaaatatttgattctgttggaaatccgttagcggaaaatgcaaccacgtacacactggttgctattattgacgatacacaaaagacgagttcaggaaagccggcctacgttaagccaagtcaggatgaaacggttgccaaacaattgtcaggtattttgggtggcgaaccaaagcattatgtcgataccctaaaaaaggggcgtgcaaacaaattaaagcaagtccagtttggtgctcacggattgaaaatcgactcgcaaacctataagaagattatggctttgaaaatacctggcattacctttacgaatagtgcgtctcgcttctatccaaatggcgtgtttgcatctaatgtcattggttatacgactgaaaagaacgatgagaaaaccggcacacgtacaattgctggtttgatgggaatcgagcaaaagtataacaagcaattgacaggtaaggctggtgttaagtcgacttcaattgatagtgaagatacaagtgtctcaaaggaagaccaatctgctaaaaacgggtatgatatttatacaaccataaatacaaaactccagacgacgctcgaagataagatgcagaatttgtatgatgatatgaagccaaagtctgcattggcgattcttttggacacgcagactggtaatattgtggcgacgacgcaacgaccttcgtttaacgcaacgaccggtgatggtattggcgattattggacgaacgaaatttctgaatcggtgtatgaaccgggatctgtcatgaagggtatcacgttggcagcggccattgatactgataattggaatggcgatgcttattaccaatcaggaaccttgaaaattggtgacaaggcagttactgattggaataatggtcaaggttggggaacaatcacgtatgcacgtggaatcgctgaatcatctaacgttgcaatggctttgaccgagcaaaagatgggcgccgaaacctggcagaattacatcaagaaattccgctttttgaagtcaacaaaatctgatttgcctaacgaagaaacgggtatgatgcaatttaagtatccgattgaacaggctaatacatcatatggacaagcaatttctgtgacgccgttgcaaatgattcaggcatatacagcgattgccggtaacggtgaggaaattcaaccacatttggtggaaaaggtggttgatccgaactccaagaaagttgtttatcaggctaagcgaaaggtagtttcaaagccgattaaaaagtcaacggcggaagctacccgtaagcagttggaagatgttatctattcagagtacggattgggtaaggcgtatgccattccaaatgtacgaacaactggtaaatctggaactgctcaaattgcgacgtcaactggttattcaacaccaggagataataatcatgaaattcattcgtggatgggaatggcaccatctgatgatccaagatatttgatgtacattgtgacaaaggagccacaacaaaatacggagaatattgctaaagatatgtcagatatgttcattacggttatgcagcaagctttgcagagttcggatgaggataataaagtggttgtcagtgcagaccaacaagtgactgttccgacagttgttgttggctcaactgccgaggcggaaaaagaagttgctgcagcgaacttgacgccattagttatgggtgatggggacactattaagcaacaaacgccagcaggcggacagaagtcgttgactaaccaacgtgtattcttgaatacgggtaaaaatattgccgtaccagacatgcacggttggtcgaagagtgatgtactcgcgtgggcaaagttagctgatatcaaaccaattattaagggggatggttttgtggcaacgcaatccattaaccctgatacacaattggctgatggctatcatgaaataacagttgagtttaaaaacgcgaaagcggaataaataagggtttataagagaggagaagtcaaatgtcgactttgttactcggactattggtggggttgattgcaacaatcatcgtagtaccgcgtttgaggaattggttcaagaaaattaaggtgcaacaattagtgatgcgctcaggtgaaaatggaccagatcacgctgctaaggctggaacacctactatgggtggtgcaggatttattccggtggttattatcggctttattatcttggcctttgcaacgggtgctaatgcgtcaactggttgggcaacgttgattgcaatcgttgtgtttgctttggttggtgcctttgatgacagtatcaaagtctttaatcaccgtgatgagggactacgtttcttgccaaagctattttcacaaattgcggcagcattgctagcagtagctgtgctattcttgggtcactttgacttcacgttggatttgccatttaatttgggtagcatcaacagtatcatcgtttacacgttgttcacgattttctggcttgtgggttggtcaaatgccacgaacttgacggatggtttggacggcttggcatctggtacagcgattattgcttacgttgcatacttgattatcgcgttcgttcaaggtgacatgacgatggtcttgttggatgcattgatgattggtgcattgcttggattcttggtctttaaccactatccagcctcaattttcatgggtgataccggatcattggcgttaggtgccggcttggcgatgaactcactggtcttgcaccatgagtggtcattgttgttgattggtttcgttttcatggtcgaaacgttgacggttatgattcaagttacaagctatcacttctttaagaagcgtattttcttgatgacgccaattcaccacagctttgaaaagggtggattgactggtaacacagataagccatggaatgaatggcaagtggatacattcttctgggcagttggattgattgctgcggttttgtatcttgtgatttttaagtaaatcatcattcactaaaacacatatcaagtcgttaaacgactttttgcattatgcaaacgtgcggggaacgccccgcgtacataactttttaaaggggatctgatcatgagtaagcatgttttggtaattggctttgcacgttctggggcagccgttgcgtctttgttgttgaatgaaggtgcgcaagtgacagtttcagacccaaaattggatttgacggatgaacgcgttgttgctttgcaagcgcaaggtgttgcgttcacgacggagcaaactgacgcgttgttagctgacgttgacttaattgttaagaatccaggtattccataccgtattccagtattggttgccgcgcaggaggctggtattccaatctttgttgaagttgcgatggcacaacgctacatcaagggaacttggattgcgctaacgggttcaaatggtaagacgacgactactgagatgattgcagctgtgctacgtacacaagcggatgacaaacatgctgttgtcgtcgcaggaaatatcggtacgccggttagtgaagttgcaccaacgttgcgtgcaaccgatacacttgtcacagagctctcatcattccaattgatgggtatgccaacggccaagccaaacatcgcgattatcacaaacatttttgcatctcacttggattaccatggcacgcgcgagaactacgtcgcagctaagatgggcatcacgaagaatcaaacttccgatgatttcttggtgattaacgttgatcgtgaagaatgggttgaattgtcaaagcaaactgcagcgacagttgtgccagtttcacgtcaaaacgtgagtcaagaaggtgcttacgaactagatggtacgttgtacatccgtggtgaagcgattatgcaagctaaccaactcggcgtaccaggcgatcacaacgtcgaaaacgcgttggttgcgattgctgttggtaagttgatgaatgtgccaagcaatcaaattgcgatgacattgcgtcaattcggtggggttgaacaccgtttgcaatatgttggcacgtttgaaggacgccaagtttataacgattcaaaggctactgatatcgaagcaaccgaaatggcattatcaggatttaaggcaccggttgtgttgttagctggtggcttagatcgtggagatgaccaaatgcgtttgcttgcagcgatgaagccacacgttaaggctttggttgtctttggacaaacggcagacaaggtggctgctgttggtgaggcgcttggtattgaagttgttcatgctgaggatgcgccacatgcggttgaaccagcttttgaattaagtgagccaggtgacattattttgctatcaccagccgcagcctcatgggatcaattccctaattttgaaacacgtggtgatttgttcgttgcggctgttaaggcacacagcgaaggaaagtagaggagatagatatgcgtattgttgtttcaggtggtggaactgggggacacatttacccagcgctagctacggttaagcaattgaagcaattggaacctgagaccgaggtgctgtacatcggtggtgaacgtggcttggaaaagtcaatcgtgccagaagccgggttcgactttaaggctttggcagtgcaaggatttagtcgctcattgtcacttgataacgtgaagacggtctatcttttcttgacggctactcgcaaggccaagaagatgttggaagactttaaaccagatgttgtcgttggaaccggtggatacgtttcaggtccagtcctatatgctgcacaacaacttaagattccaacggttattcacgaacaaaattctgttgtcggcgtgacaaataagttcttggcacgtcatgtgacaaaggtcggggttgcttttccagcagctctaccagcctttaaggatggcctggcaacggttgttgggaacccacgtgcccaagaagttgttaatggcgaaggttcatttgactgggacacattgcacttgtcagcagataagccaacggttttgattttcggtggttcacaaggggccttgaagttgaacaaggctatggttgccggcatgtcaaagtttgctaaccgcccataccaagtcatcttcgttacgggtggcaagcgttatgatgacgtgcaagcggatctacgtgctggtggggtcgtaccagctgagaacattgctgtggtaccttacatcggcaacatgccacaattgatgccggttgttgatttggttgttggtcgtgccggagccacaagtttggccgaacaaacggcattgggtaagccaatggttttgattccaagtccatatgtgacgaacgatcaccaaacgaaaaatgcacgtagcttggttgaagctggagcagcggaaatgattactgaagaatcactttcaggcacaacgttgttcggcacaatcgatcacttgatgacgcacgatgatcaacgtgcggctatggctaaggcagccaaggaattgggtgtgcctgatgcggcataccaattcatcaagttgattaaaacagttattaaataagataagtaacgattggaaaggaggcatatgatggccaaagaaaatgaatcaaagccgaaaggaacaaaatctagtgatattcaggcacacttagatgcattgttgtcggaagatgactggtcatcattgccaacgcgccagtcgaaagaaaaaaaggctcgtcgtgaattaaaactaacgcgtcggttgcgtgaaacgtttgctgaagaaccggaaacaagtgacgaagaagagattgaagtagaaccagaacaagaaccagaacccgtaaatgctgaaccactgctgttcccgtatgaacgggcggcaattctttcagcacttgggctaacggtcctggcaggaattctaatctacctcatgtcaccgcttagtcaggtcatgcattataaggtagttggttcagaaagccttagtgctgatacggtcctagatgcagcccagctaaaagtggggcaaccgttgctaacgacgatgcaccaggctgattatttcagtcacacagctgaagaacgcaatccacaaattgcgggacttaaatttgaacttagagctgacaatacaatcgaagttaaggtgaatgagattgttaaagtcggctacgtgaaatcgaatgatcattattatccgattttggcgaatggtaagatgttgaaagatggtgaagtgaaccaaccaattggtgggttgccactttacgacaacttcaaatccgactcagatttaaagcctgttttagctcagtttggtaagttaccactggcgttgcgacgttcagtgtcagaaattgtgtggtcaccaacggatcaaaacaaacaacgacttgagttatttatgaatgatggtaatgaagtgttgatcagtgctgatgagttggctagcaagctgaagtactacccagcaatggcagcaactttggatgacaaaaagggaattgctgatttacaagttggtgcatattttactccatacggataataagaatttcgttatcatttttaaagacaaaaacaggataatcccgcatgaggtatggaagaaaccttataaagtatggtattatcttaaagaattgtttatttattaaacatcatctgattggcagttaaggaggtactcaaatggccaaccacgggttaatagttggtctcgatgtcgggacgaacacgataaaagtgctagcggcggatgttcgagaccagcaagctaacattgtggcggttggtcgttcgattgcccacggcgttaagcgcggtgttgttgtggatattgaagcaacagccaatgatattcgacaagcagttgcacaaattaatgagcaaacaagcacgccagttactgaggtagtggctagtttgccagcaagcaacattcaaattcaaaatgtcagcgggacggtaaccgttaaggatagtcagcatatttcatatgaggacgttgcggcagccgttaaggaagcgacaaaagttaactttccaagtgatcgtgaaattatcgaactgttacctacggaatttattgtggatgattttgatggtattcaagatccaaacgatatggtggggatgcgtctagaaatgaaggcggtcgcatatacagctcctcgcaatgtgatggggaacttgcgtatggcgattgcaaaagccgggttgcaactacgtgactttgttttgacaccgcttgcttatagcaagacgattttggacgacggacaacaagaattcggtacgattattttggatatgggtgccggacacacgacggcgacggttgtgcacgatcatcagttgaagttcttgtcaacattcccagcaggtagtgacaatatctctcgtgatattagcgcagtgttggaagttggcttgcatgatgctgatatgttgaagcttgattcaggattagcgctttcaagcatggctcgcgaagataataagttagttatcaagaagattagctcagaaaacgctgagcaaatcactgaggttttgctggcacaaattatcgaagcacgcttgatgcagattttggacaagcttggtgagaagctacaacttgtcggggcatttgacttgccaggcggcattgttgtcgtcgggggtggtgcagcgcttcgaggtatgatcgaagccattcgcagtgtttataatgttcaagttaagtcgttttcaccaacggatatcggcttgcgacaccctggcttctctggggcgtgggcattggttcattacgctgcccaacaatcaccaattcaattgattgttaaagaagccttgtacggattgccattgacagttgttggtcaaccaacgattgcggtggcgacgccggtgcaaaagccagcgacgaatcgccgacctgctcgacctgaaagtcaagcggttgttgaaccatcagttaatgacacggacgatgtcaattacgatgatgaagacaagcctaagaagaagggggcattccttaacttcttcaaggaattcttcgactaaacaaaaaagaaaagataagtgagaaaaaaggagctcgttatggatttccaaatggatatgaaccaagagtacggcgcaacgattaaagtaattggtgtcggtggtggtggtggaaacgccgttaaccaaatggtgaatgacggtgttgaaggtgttgagtttattgtagccaacactgatgcccaagcattggagcgttcagctgcagaaaacaagattcaaatcggtgctaaggccactcgtggtttgggtgctggagctcgtccagaagttggagaagctgctgctaaggaaagcgagcaagaaattgcagatgctttggccggggcagacatggtcttcgtcactgctggaatgggtggtggtaccggtactggtgccgcaccagttatcgctaagattgccaaggattcaggtgctttgacgattggtgtcgtaacgcgtccattctcatttgagggtccaaagcgtggcaagtcagcagctgaaggtttggctaagttgaaggaaaacgttgatacgttgatcgttatcgctaacaacaacttgctacaaattgttgataagaaggccccaatcatggaagccttcaagatggttgacgatgtcttgttgcaaggtgtctcaggtatctcagacttgattactaagcctggtatcatcaacttggacttcgctgatgttaagacagccatggctggtcaaggaacagctttgatgggtattggttcagcttctggtgagaaccgtgctgctgaagcaacgcgtaaggctattgcctcaccattgttggaagctaagattgaaggcgctacgaacgtattgctttcagttaagggtggcgctgatatgtcattgtttgaagcacaagaagcttcagagacaattgcacaagctgctggtactgatattgacatcatcttcggtacaacgattgatatggaaatggaaggcgagttggttgtaactgttattgcaactggtatcgaccgtccagcaacgccacgtccagaaatcaaccttggcgcagctaacacggctagcccatttgaagcagttgctgagccggtagcacctgtgcaacaacaaactgcaccagtgcaaccacaacaaccagttaacacggatcctttcgcagattggaacgtgacggctgagccagcacaacaagcaacgccagcacaacaagctgcaccagttgagcctgttcaacctctttcatcagaaaacacggctgctgacgaagaaattgagcgtccagcttactttaactggatgaagcgcggcgaaaagtaaggagacaaccgatggcttttgagacttttagaaactttttcatgggatcagatagtgattattactatgaagaagaagaggcaccggaagaacaatacgtgcaagaacccgcacaacaagcaacgtcaaaggctaagcctgctaatgcgaatgcaacgcgtccaacggcaacacgccgtcctaacgttttgccaatggatggatcacgtccaggcgagacatcaaagattgcgttgtacgagccacgtacttacgctgatgcccaaacaatcgcaacgcaattgttggctggcgaagcggttatcgtaaatctaggttcaattgacgaaaacacgggaaagcgtgtgcttgactatctaggtggtacagcatttgcggttgacggtatcattgaacgtgtcggtgagcgtatcttccttgcaacgcctcacaattttgagatttcaggaacgatttctcaaaatttgggacaacaatttaattaataggtgaccaaatgttaacactcattttatcgttattgatgttggtcttgcgtgccatggagttcgtaatcttgatttgggtgctgatgtcatggttgcccggggcacaacaatcagccttgggacaattgctgggtcgtattgctggaatcgtggttgatccaattcgtcgtgtgatgcctcgcacgggaattatcgattttacgccattgattggtttgctactgttgcaagctgcccaagtcggcctacgcgcaattgcacaagcattctagagaaataaatttatggcagataatgtatcacaacatttccgcccgagcgaagctgcatttattgatgtagcgcaaggcttaattcgtcaggcattggatgagtatcgtccagtactgacgaattttttgaacccgcggcagagatatattttggagacgttggtcaaccaacatgatgagttaaagattgctcattccggtggctacactgacgccgaaagtgcacggtccttgattgcaccggattattacgatgtacaacaggacgattttgaaattgctgcaatccgtatcaactacccaaccaagtttgctgaactacatcacagtacggtacttggtacactaattaataatgggttatctcgagatagtttcggggacattattagtagcgaagagggtgattggcaaattgttgcaacggaacagatggcgcgatttatcacgtcatcattggatcacgtcggtaaaacaaaggttcgttttgaaccaatgacgctagctgatatcgtgcccccccaagaggagtgggatgatatcaatacaactgtctcgtcccttcgactagatactatagtggctaatgggtataatgtatctagaacgcatgctaaagaattagttgagcgtggtatggtccgggtgaactggactgagattgaccgaccagattttatgctggcggttaatgatttgatttcggtgcgtcgattcggtcgcatgaaattgctagctgaaaatggtataacaaaaaaagataaatggcgcgtcacattggccgtcattaagaaatagattggagaacgatcatggcattgaccccacaagagattcacgctaaggaatttaacacaaagagcaacaagtggtacgacaaggctgaagtaacggccttcttggaccaaatcgtaactgattacgatggcttgctacaagaaaaccaaactttgaagacgcaattggctgaagctgatgcaaacgctaagcaagttgaagagatgaagcaatctgttaactcatcaatcttgattgcccaagaagcagctgaccgtttgaagaagcaaactgaagctgaagccgaagcaacgttgcaacaagcacaagctgaagcacaaaagattgttatggaagccaacgctaaggcaaattcattgttgactgaatctcaatcaaagaacgaagcattggttgctgagcacgatgctttgaacaaggaaatgggcgcattcaaggctaagattgaaggcatgttgaacgcacaattggacttggttaagactgatgactgggctgcattccaacaacctgccgcattccaacaaccacaatcagctgcaccagttttgccagattcatctgcatcacaagctagttcagaggtagaaacggttgttatcttccctgaatcaaacgaaaacgaagaaaacttcttgaataaggactaatttttcgttatcatgtaatcatggtttcttgaccaaacggcaagatgtattccaaacagcgacctaggatttacccggtgagagcctaggatggttacgcagcttgtttatcagcaagaatgattttttaaatacacagaagaggcggctttttgccgtgaattcgggtggtaccacgttgacatgacgtcccgcattggctattttggccgatgcgggattttttagtttcagggtaagccgcatgtcaacgcggtagcacttggattgaacagaaaggattgcgcttttatgaagatgaagcaaaccttgaacctaggaaagacgaagttcccaatgcgtggtaacctaccacaaactgagctacaacgtgaaaacatctggttcgagaacaaggtctatgagcaacgtcaaaagatgaacgaaggtaagccatcatttatgcttcacgatggccctccatatgctaacggaaacattcacatcggacacgcaatgaacaagatttctaaggatatcatcgttcgttacaagtcaatgaatggtttctacgcaccatttgtccctggttgggatacgcacggtttgccaattgaacaacaattgacaaaggctggtaaggatcgcaaggcggttggaccagttatctggcgtaagatggccgaagaatttgcgcgtaagcaagttaagacgcaaatggccgacttcaagcgtttgggaatttcagctgactgggataacccatacttgacgttgttgcctgaattcgaagctgcacaattgcgcgtcttcggtgagatggccaagaagaacttgatctaccgtggtaagaagcctgtcttctggtcatggtcatcagagtctgctttggcaatggctgaaatcgaataccacgacattgagtcagacacggcgttcttctcagagcgtgttaaggacggtaagggcttgttggataacgacacgtacttcatcgcctggacgacgacgccttggacggtaccagcttcacaagctttggctttgaacgctgatttcgaatactcacaaatccaaccaaagggttcagacaagaagtacatcgttgcttcagctttgttgggtgccgttgcacctaagttcggctgggacgagtacgaagttgtcgcaaccttcactggtaaggaacttgaaatggtgacaactgagcacccattcatggaccgtgagattttggttgttaacgctgattacgttacggcagatgccggtactggtgcggttcacacggccccaggatttggtgaagatgactttgctactggtcaacgttacaacatgccagttatcatgaacgttgatgaccaaggtaagatgacggctgaagctggtcctgactttgaaggtgtcttctaccaagatgctgacaaggttgctttgcaaaagcttgaagaagctgacgcgttgatcttgcacgagcctgttgtacacagctacccatttgactggcgtactaagaagccagttatcttccgtgctgtgccacaatggttcgcttcaatcgatagcttccgtcaagacattttggatgcattggacgatgtaacgttccaaccagaatggggtaagaagcgtttgtacaacatgatccgcgaccgtggcgactgggttatctcacgtcaacgtgtttggggtgtgccattgccaatcttctacgctgaagatggtacggcaattgttgaccctgaaatcattgaccacatcgctgacttggtagctgagcacggttcaaacgtttggttcgaacgtgaggccaaggacttgttgccagagggttactcaaacgagcactcaccaaatggcgaatttaccaaggaaacggacatcatggacgtttggttcgattcaggaacttcacaccaaggtgttatggccactcgtccaaacctaagcttcccagaagatttggttttggaaggttctgaccaataccgtggttggttcaactcatcattgatcactggtgttgccgtaactggtaaggccccttacaagtcagtcttgtcacaaggattcgtcttggacggaaacggtgagaagatgtctaagtcattgggtaacatcatttcacctaacgaagtggtgaaggagatgggtgctgaaattatccgtttgtgggtaacgtcagttgattcatcagccgatgttcgtgtatcaatggacttgttgtcacaaacttctgagacataccgtaagatccgtaacacgatgcgtttcttgttggctaacacgtcagactttgatccaaaggctgacactgttgcctttgatgatttggtcgcagctgatcaatacttctatgcccgctttaacaagttggttgctgacatcaaggctgcctacgatgtatatgacttccaagcagtaaacaagttggttatcaactttattaacgttgacttgtcagcgttctacttggactttgctaaggacatcttgtatgttgaagcacctaagggtcacgctcgtttgtcattgcaaacggtcttgtacaaggtcttggtagacttggacaagttgttgttgccaatcttgccacacacggctgaagaaatcttcgagtaccttgagcacgaagaaggcgactttgcttacttgactgagatgccagttgttgaagacattgctaacgctgacgaattgatggctaagtggtcacaattcatgacgttgcgtgatgccgtaaacaaggcgcttgaagttgcccgtgatgccaaattgattggtaagccagctgaagcagcggtaacgttgttcttgactgaagaccaaaaggcatggttggattcattgggacaagatgtgcgcgtcttgttgcttgtttctcaattgcacgtggcatcagctgatgaagctggtgatgcaactgactttgatggttacaagattgcggttgctcacgcagaaggtgaagagtcacctcgtgatcgtatgtaccacactgatttgggtgcagatcctgacttcccaatgttgtcagcacacgaagcacaaatcgtccgcgagaacttccctgaggctttgactgaaggcttggagtaatcacggttacacaataaaaatataatatcgataacaggaaaacgtcgggagatttttgtctctcggcgtttttacgtctataatgggaggtataagttttttggtggttagtgtcgacgcgtttcgtcgaggcatagaaatgtgggactctcttcggccgtcaggacggacacaaaccaccaaacctaaatacataaccaatcaaagagaaggagaccaacgcatgacgaagctatacttcatccgccacggtaaaacagaatggaacgcagaaggccgttttcaaggagcgggtggtgattcaccgctgttgcctgaatcatacgatcaaatcaagatgcttggtaaccacttgaaggatattgaattcgcacacgccttttcaagtccaatcaagcgagctcgcatcacggccgaagaaacgttgacaatgcttaacaagcgccctgaattgacgtttatggacggtttgaaggagttttcattcggcgtttgggaaggcatgagctttggtgaagttcaagaaggctggtatgacatgtacgatgcttctcgtaaccacccagagaagttcgatgcgagtcaggttgaaggatctgagtcattcgaaagtgttcaaaagcgtttccgtgaggcagttgaagaggctgttgccacgtacggtggtgaagatgtgaatttggtcttcttcagccacggcgctgctttgacgacgggaatgggtggcctaattggtattccattggcggatttgcgtgcacgaggtggcttgggtaacacaagtacgtctatcctagaaacgcatgatgggcacacatttacggaaattacacgaaatgatacaagttatttgggtgtcgcaagtgatgcctcaaatacaatttaaagagaagaaggatttttaagatgacgcaaccagaaaatgcagcacaagcagatatcgctcgcttggtaagtgagattaacgctaacccagacaactggcaagcctatgcagacttggtggctgttttggttgccacggaaaatcttgtggaagctgaagaattagctttgaagagcttgggcttgttccaagcgaacgatgaagcgttgcaaaatctactctatgcagcagggaacgtttattatgttgctggggattatgcgcgcgcaaatgagtttttcgccaaaatcactgatttggagattttgcatgatgcaacggttatgcaagcacaagcatggtatgcacaaaatcaattccaaaaggcattggtgtttgcgttgacggcagttgagcaacaaccagaagacgttgcagcccaagtgctactcggtaacatttggcttggtttgcaaaacatggataaggcaacaactgcgtttaatgacgctattcatgtggatccaatgaattttgacgcaaattttggtcgaggtattattgcaatcgttgacggtgaccgcgagaatcaatggtcagcaacggctgaaatgattgatatggaacgataccgtgctcaagcacaacgattggatgaaatcgtacaactactatcagggagtcgcgtagatgagtcagagtcaaactagtttgttcgatggcccagcggcatcggatgagacaccgacggttactggccaagtgaagaatattctgtttgctgcccaagattctttttataaggtcatgattatcgaagtggcggatcaaaatttcgattatgatgatactgagttaacggtgactggtagttttggtgatattcaaattggtgccagttatgagtttaagggacgtctaacaacgcacgcccgctacggggtccagtttgcagcgcaaaactatcaacgtcaggcggccagtacgacgtctggtttggtggcgtatttgtcaggtgaccaatttccaggggttggaaaagcgacggcaacgaagattgtagacgacctggggattgaagcgattgataagattttggaatcaccagacgttttgattgaaacgggtatttcaacaaaattgcaagaagtcatcgtgaagcagttgcaacaatcggacggtatggaacgcgccatcattgcccttaatgattatgggttcggttcagcattggccaccgtgatttaccaaaagtatcagcagcaaactttacagattttaaaaacaaacccttaccaaatggttattgatattgagggcgtttcatttgcacgtatcgatcgactagcagctcagcagggaattgatgcgttggacgcgcgacgtatccaagcgggggttatttcagcgattaaccaggcgacattcgagtctggtgatacttttatgcaagtggaagcgttgctacaaaccacgcaacaaattctagagcgttctcaaaatgcacgcattgatccagcgttgattaagcgcgcgttattgacattaacttctgacggtatcgtcattgccgacggacagaacttgtacattaaggcgttgtttgaagctgaacgtgaaattgcgcaacgtatggtgcgtctaagtaaaacgaagaacagtgaatacaaacgagctgatgttgtaaaacaattggctgaagtcgaggaagaaaatccgtttccatatgatgatgtgcagcgcgatgcgatgattgctgctttgatgagtaatctctttatcctcactggtggaccgggtacaggaaagacgaccattatcaacggtgtggtggcgacgctcaagaagctactacaagacgaaggtatgaagtgggatgaaattagtgagagcattcgtttagcagcgccaactggtcgtgcagcgaagcgactttctgaatcaactggcatgccggcttccacgattcaccgtctgttgggtattactgggcgcgaaaatacagacgatattgatattgaggaattgagtggtcgtctgctggtcattgatgaaatgtcgatggttgatacgcaactattcgatttgttgttacgtgcgattccaaatgggatgcaagttattttggtcggcgataaggatcaattaccatctgttggcccaggccgtgtattctacgatttgttggccagtggattgttgaattatcgtgagttggagacgattcaccgtcagggtaaggggtcaacaatcattgaactagctagttcagtgaagagcggtgtcttaccagcgacctttaccgagcgtcagtctgaccgatcatttttcccggcacagacaaatcaagtgccacgtatggttgagcagattgcgacgagttggaaggaacgtggtaattcagtcgctgatatgcaaatcttagcgccgatgtatcgtacgccggccggtgttcacaatctgaatgctgtggcccaagaaatctttaatccgatgacggccaagaaacgtgaaattcacatgaaacttggtgagctggagttcaacttccgcgttggggataaggttatgcagacggccaatgatccagaacataacgtgtttaatggcgatattggctacattacggcgattatgttggcgaaggataaaagcaacgaggataatacggataacattacagtggcttttgataccggcgaggttgagtatacgcgccagaactggaatcaattgacgctagcgtatgcgacgacgattcacaaggcacagggtgctgagtataagttggtcatcatgccacttgttaatgcatttagccgtatgctacaacgtaacctgctgtataccgggttaacacgtgccagtgaatcattggtccttatcggtgatgtcagtgcctatcaacgtgcggctgaaacagagggtgtcaatcgacacacgacgttgcaggaacgccttcaacaggcacaggatggtcaactgccggatgtgccggacgatgataaatcattggcagcggtcaacgcaattaatcaaaagccagtggcggttgtaccagtggacgaggaaaatacaaccattgacgatacgccagtggttgatgaaattgtccaggctgttgccgaagatgatgacgatttgctcacaattgctaaaattatggatgaatcaattgacccaaatgtggggatggcagacatgacgccatacgacttcatgccttaataaggatgtaacggtagcgcgtgactaacattgtgctataatctactagtcaagcactagtgaattgtgctaaaattaatcgataaattttcgaatgaaaaggggtttctgaaatgtcaggacacagtaagtggcataacattcaaggacgtaagaacgcccaagacgcaaagcgtggtaagatcttccaaaagcttgcccgcgatttgtacacggcagctaaggctggcggtgtagatccagactcaaacgcttcattgcgtttggttatcgacaaggctaaggcagctaacatgcctaaggataacatccaacgtgccttggataaggcttctggtgccggtggcgctaactaccaagagttgacgtacgaaggttacggaccagccggtgtggccgttttggttcaagccttgactgataacatcaaccgtacggctgcttcagttcgttcaacgttcaagcacttcggtggtgaattgggaacgactggatcagtttcattccaattcgaccgtaagggttacattgaaatcgagcgtactgaagacaacgatatcgatgaagatcaattgtttgaagacatgttggaggctggtgccgaagacatgaagacttacgatgaccaattcgaaatctacacggaccctaagtcattcccagaagtacgtgatgctttggaagcaaagggttacactttggtcaacgacgaagttacgatggttgcacaaaacccaatggcagtgcctgaggataagcaagcatcattggctagcttggttgatgaacttgaagaaaacgatgacgtacaagctgtcttcacgactgctgagtaatcatcttatgaaaaaccgaccaaatttggtcggtttttttgtaggcgcaaaagttgacgatgtgaacaaaaagcgataaagtagtaaacaattattaataacttgagtcgttaacgtgtttcgccacagactcggaacaaaacgtgtttaggcatatctatatgctggacaccgttaacgacgccgagagtaattcttttggcgtcgttttcttttcctgtatcatttggcgaaccgtaatgatacaggattttttaggagagataagcatgttagaacgcttttttaagttgtcagagaacaacacgacggttcgaacagaagtggttgctggtatcacaacattcgttgcgatggcatacatcattttcttgaatccttcagtattgtcgatgacaggaatgccaagccagggagttttcttggcaacaatcttgacggctgttgtgggaactcttatcacaggactttttgctaatttgccatatgccctagcaccgtcaattggtatgcaagccatgtttacgtacacgattgttttcggactggggtacacgtggaagcaagctttgggaatggttttcttggttggtttggttgatgtgattatcacattgacgaaggtccgatcaatgattgttaaggccatccccgaccaattgaagcacgccattgcggccggtatcggtttgtttatcgcttatattggtttgaagaacgctggtttcttgaacttcttggttgatccacaaaacatcatgacgttgaatggtaagccatttactgaaggtggtggtgccaaggttattgagagcatcacagcaaacggtgggacgacaccatcaatctcaacttttgcgcaaccagcagttttgttgggattgattggcttaatcattttggttttgttggtcgttgctaatgtaccaggtgcgttcttgctttctgttttgattacgaccgtgattggtattccaatgggtgtgacaaacacgcacatcgatgccatggcatcattctcatcaacgttccacgactttggctcaatctttgggcaagcccttggacctgatggtttgtggtcaatgtttacatcaccaaagcacgttttgattgttgttttgacggtcttctcaatgggattgtcagggttgtttgacgccatcggaacgtttatcgggactggtatgacgactggtatcttctcagaagctgaccaaaaggagttctacgaaggtaagggcttcaagtcaaagatggatcgtggtttggttgccgacacgttcgcaacaatgtttgctggtatcttcggaacatcaaacacgacgacgtttatcgaagcgtcagcaggaatcaaggctggtggtcgtaccggtttgacatcagttgtcatttctattggcttcttgctagcgattattgccgcaccattggttaacgtgattccatctgccgccacggcaccaattttggtcgttgtcggtattatgatgatgaatgagtttaagttgattacatgggatgatattgaaattgcgattccagcattcttcacatcagcattcatggctttctcttactcaatctcatacggtatcgctgccggatttattttctatgttttgatcaagagtgtgaagcgcaagttcaaccaaatcagcccaattttgtgggttgtgaccattctgttcttgcttaacttcatttcgttggcaattaattaataaacaatatttaacgcgttatgccttgtgtatcacgcgttttttgttgtcataaatcctatgaaataaaacaagtcgaaaaataattggaaattatcgtggttttggcctctttcttttcgaaggaggtgaatgagatatgagcgttcaaaaacaatttgcgtcgttagtacaaactgctgcccaggtgagggcaagtgatttgtacgttatgccgggagaagcgggataccgcgttttttgttacacagcaaccggtattcaaccattagctgatctgacattagcgaatggtgaagcgttgattcgtcacattaagtttgaggcgcaaatggatatcagtgaaacacggcgaccgcaactgggacgctggtgttatttgcttgataaggagcaactgtatttacgaatttccagcgtgggagattttttgaatcgcgaatcaattgtggtgagattgatttttgctgttgatgaccagcatatccagttgacgtcacaaagcgatgttgcagctatcggtgagacgatgatgaatggtgctgggttaattttgctggctggacaaatgggctcaggcaaaacaacgaccttgcattacttggcccatcgatatttagcagagaaaatggttctgactatcgaggatccggtcgaagtggtacaaccaaattttctgcaattacaggtaaataaggcagcacaaatggattatccggatttgttaaagcttgcattacgtcatcatccagacgtgatgattattggcgaaattcgagatgcacaaacggcgcaaattgtggttgaagcagctttgagtgggcacttaatcatcagtacaactcatgcgatgtcgcatatgggtatctggcatcggttacgtgactttggtattccagctggaacgttgcgtcaggtgatgggaggcatggtctatcagaagttagtcatacaggatggcaacacggcagctgacttagcagttctaacgggtgatgcactggcagaaaggatggctgattggcatgcagagtaaacgatggtcaaaaccagcgcaagttgatttttttgagacattagcccaattgattagcgttgggtatgacttagaaaaagcgttagtgtcgctccaatcattactgccgaaattgcgaccggatttgcaagtgattgttgctgggttgcgagaagggcggcatttttatcaactggttacaccgtatgttcggtcagaattcagacgtgagttagcctttgcagtagtccatggcaatttaatggaaattctagctgaaattggcagtcgtgaacgacgccggatgcgacaaattcaaaaattgcgccagttactgatgtatccgattgtgctgtttgggctgttagctgttatatttgcggtttttgtgcagttccttttacctgagttcacgaacatggggatggcattaccgactcttgtggggttgccagtagttttatcaatagtcgccgttacgttaataggtattgttgtgactgggatagtctggtggcgacggcattcttggttgcaaaaattggtggttctcagacgcttgccgttagttgggcctgtcatccgattgagtttggattatcaaatttcactacagttgggattgctgttaacgagcggcgtcagtttttctgtcattgtcaaacgctttgcaggcttagaagaaggtggggtactaaaagaagttagtcaattagcagaaagatcactaacagctggcgaaagtattgccgagtttgttacgaaggtaccattattaccgcgtgagagtgagttgctgttttcaaaaggcaaacagcaacaagagattggtcaagagttccagctgctagctgagcggaaatttgagttattagaacgacagattggtcgttatttattgattattcaaccattatgctttggcgtaatcgggttagttgtcgtcggcttatatctattgatgttgatgccgatgtatcaaaatatggtggatttaatgacatggtaaagcaaaacaagcgcaagggattcacattgattgaagttgtcacgactgtttttattattggactgttggtattgctggtattaccaaacgttaaccacgttcggacatttgcggaacgtaagcaacaaacagccttggtacaaaccgtgcaaacgcaagtagatttgtaccgcaacgaaaatggcagtgcgcctgctactttgaaggacttggctgataagtcgtatttatcagaaggacaattggcccaaattgataaggcagcgattacgttgaagggagatcaagttgttgcaggtaagaagtagaccggcatttacgttggttgaaagcgtggttgtgttaggtgttatgggcgtgttaatcaccagttttacccttatcccacggtcagaaaaacagacttggtcgaaattcgagcgtgaatttaacgaagcctatatgattgcacgccaaagacaggttggtcggaatgaagagttctatattgatgttcgcgaagaccatgtcaatgttgacggacaggttatccgggtcccagcaaattggactggtggcctaagagtgattcgttgccaagttttcacgatggcaccaattagttttgcgctttataacaaagaaacgatgcgaagacggaatgttgtctttcagctgggaggtggtacttttcatgttgatccgtaaaggcgcattattatcagaagcgctcgtatcactattactcgcaacaatgacaacttggttaatcgtgacaacaatgcaatactttaaccgcatacaggttgctgaagaagcacgcatgaaagaggcacgtcgacaatattatgaggaacaaaaaagatggctaaacgacgaggcttcaccctagctgaaacgcttgtggcgttaatggtctttagtatggcgttaagtttattgggggggctgcaacgaacctaaaacaacattatcaaagcaatcgaaatcagcagcgtgaggcacaagttgcccgatcgattatgtcattggaagcaccagaaacaggattgacgctaaaaacgtgttttaaacgccaattgattttgtacagcaaaataaccgataaaaaatattatttggatgtcagacataaggcatttggtttgtatacacgtcaaggtgggaacatgagatatctcaatcaggttagccaggtgacttatgtacaattgtccaagcaacgggtgcaagccaccattcaattcgaggaaggggtaaaagtgacacaggagataactttttatgaaaaatcggcagggtagtttgttggcgcagacgttaatgctgctgctactttgtttgagcgggttcactttttgggtagcaggacaaagtcgccaacaacaagctaggcatttagtgatagcaaattggacgaagcggcaagaagcgttgcgttttttgatggccaacccggaagcacctgttatgccacaaaacacaaccaactatccagcggtcattgaaagagatgagctcaaagaagtggtacttgttgccgaaaatcatcgcgttgtgataccacgatatcgtcctgtaaaatcctagaattgttgagaaacagctgaaacctgctacactgttatttagtataaaaaagaggtgagcgcatgtttgagacaatcgaaaacgcagtaaagcatttacaggcagcacaaaaggaaattgctgacgctttggatatggcagcaattgaagctttggttgtgatgattgaagtgatgttgaaccaagaagatgaagaatgggcaacgttatctgaagagcaacgtacggcgattgttgcgatgattgacgatgcggcatttgatgggatgacggttgaattgaagcgccaagtgttgcaattgcttttggttgcaacgatgcgtgaagatggtctgcaagctaattatcaagtgacaccagatgctattggtatgtgggtcggctttttagctgagcaattcacagcgcagaatgcaacggcgaacctactagatttgacggtcggtacgggtaatttgttggcaacggtgcaacaagtacttgcccaacaaggtaatacgttgaccatcaacggtgtcgaaaatgacgatacgatgctaacggttgccagtggtatggcagctttgcttggctttgactggcaattaactttagctgacgctgttgctagtgatcttccaactgatcaagatattgttgtggcggacttgccggtcggttattacccagctgaagtaccaagtcactttgtgacaacggctgaagatggtctgacctacgtgcaccatctgttgattgaacaagctatcaacgcgttgcgaccaggtggattggcagccatcattgtgccagcaaatctatttgagacggaacaagcacaatcattgttgaagtacttgcaatcagaaaacgtgtacttccaagcgttgttgcaattcccagataagttgtttgcaaacaaagcggctgcaaaggcaatcctagtcttgcaacgcgcaggtggggatgctattcaagcgacgccagttatgctggcaaaaacaccagaattgactaacgttgcagaaaacaaggatttcgtgacagaaatgacagcatggatgacggcgaaccacatgctacatgcgtagtcgtacgactgaaacacgtccgaaatagttgacaagatattcataagaaattgtgatatactaatctgcagatattgaacaattccgtttggaaaagaggagacaagtacacatggctaagactatggcgattaatgccggttcatcatcattgaagtttcaattgattgagatgccagcagaaaaggtatttgcaaagggacaagttgaacgaatcggtttgagcgattcaattttcacgttgaagtttaacggtgagaagtttgagttgattcaagacatcgacaaccacgaggctgccattaacttgctattggaacaattaaaggaacacgaagtcattgctgacttgaacgaaatcacaggtgttggacaccgtgtcgttgccggtggtgagtggttcaaccactcagttatcgttgacgacgaagtgttgaacaagattgatcgtttggctgcttatgcaccattgcacaacccagccaacgcaatgggaatccgtgtgttccaaaagctgttgccaaacgccacgtcagtagctgtatttgacactgcattccaccaaacgatgcctcgtaagaactacttgtacgcattgccatacgagtactacacgaagtatggtgcacgtaagtacggtgctcacggaacatcacaccgttacgttgcagctcgcactgccgaaatcttgggtaagccattggaagacttgaagattgtgacattgcacttgggtgccggtgcttcaattacggctatcaaggatggtaagtcattggatacgtcaatgggcttcacaccattggcaggtgttatgatggcgacgcgttcaggtgatgttgatccttcattggtttactacatccaagagcgtgaaggtttgactaacgatgaaatgcttaacatcttgaacaagaagtcaggcttgttgggtgtatcaactttgtcagctgatatgcgtgatttgaaggctgttcgtgatacaaacgaacacgctgaattggctatccaaatgttcgttgaccgtgttgttcgctacattggtcaatactacatggagcttgaaggtcttgatgctatcgtctttacggctggtatcggtgaaaacgccgatgacttgcgttcagaaatcatcaagcgcctgaacttcatgggtatcaagatgaacgaagagcaaaacaagcaacgtgacgacgagatgattatttcaacggacgattcttcagttaaggttttgaaggtcgcaaccgacgaagaaatcatgattgctcgagacgttgaaacgttgaagaacgaaaagtaattcatttcttaatagcgattaaacaaccgcgaatctcatttatttgggattcgcggttgtttttttattacggtcagtcctgaaaataagaaagtcgttaaacgagttttcctaacatttttcttttatacaaaaaaataatcttcgatacacgtcagatacatacttttttaaggtagtgcttccgaacaatggtggctttgctaaacttctaagtgtaaggaagaggaggaaagagacatgatgagaaaactacaaattgcattagcgacagcattgacattcggcattagtcaagtagcaacgacggcatatgctgataatagtgcactcggcgttgatccaattttcccaaccacacaaattgatacaaaaactggttactacgatttaaacgttgaaccaggtcaagaacaaaaccttgaaatgacgttgatgaatgatggtgacaagccaatgcgtgttcacgttagcgctaatccagcttctaccaatgataatggcgtcatcgaatacggtaagaacaatatcacggtggacaaatcactaacagctaatgttggcaagatgatttcggtacctgatacggtttggattccagcacacggtacaacacaatttactgcgaagttgcgcgttcaaaaggaacaatttagtgacatcgcagtgggtggcatctcatttgtaacggatgctgataagggacgcacgcaaagtacaggcgtgcaaatcaacaaccgatacgcttacgacatgggggtcgagctgcatgaatcatccgacaaggtggcaccgaacttgaacatacatcaagtacgcgcgacgtccgttaattatcacacagcgatccaagcgcgtttgcaaaatgacaagcctgcgttcatcactgatatgaaatcacatgcagtgatttacacagctaaggatcataagcgagttcttgctgaagataagaagaatcaaaaagtcgccccaaatagtcactttgactacacaatgatgatggctgatggtcagaagttagcgccaggcaagtatgttgcagacattgatttaactgcgaagcaaggacactggcatttcaagaaagaattcaccgtaacggccgaaaaggcgcgaacgttggatgaacaaaatgtcacaatcagtcactgggcttggtggcaaatcttattgttgattttgctaatcatcttattggccatcttgattatgtacctagttcgtcgcgaccgtaagcgaactgctgagttacgccgattaaagtataccgttagtgaggtaaccaaaaatgaaggtaatcaaaactaataatttcataaagccactgattgtcctgattggtgttgcagcgacgttaacgatgccatcccaaatggcgtttgcggatgaaacgttgcagccgggatcacatatgcctgcgaaggatgtctcgccagatcctaagacttttgacgatgagcactcggttgttcgaaccacaccaacgcaggggccatcttttccaacgccagcctatcggaagggtgttagcgactggcaaacgctaaatggtcaggcagacggtggtgcgtatggtttttcatcggcagcttttcaacgtcctttacgcactgatcatagcttttctttgaagagccatggttacatcacgtcagcaaataactacttgtacacgagcgactttcttggaattgtcctttcaactgcgagtgcggacaaattgtctagtgcgcaatctggtggtgtgaaatgaaaagctggatatgctaatcctgatgtggcatggcaaacaaccttcggtacgcaagcttttggtgagacacactacacgttcctagtgcccggtattactagcatggatcataaaaattttgtacgtcagacgatatatggcaagcaaacacccgtgacagaaagaccatttgattctacgcgttggaaagcaaagccaatttcagaagaatacaacgtgaattatgatgctgatacacgaaagatttcatacacggataataaaggtttaacggcaactaccgatattcctaaagaagtgccacgtgtttacatcggaattctaacgtcggtacaaggaaatggttattacgacaaaagctacattgggcttgacgacatcagcggtacgtacgacacgaccacaacaacagtgcgtttcgtagacaaagatggcaattcactcgctgatgatgcaaaaatcgacagtatcatcggagctaagatttctatttcaggtagtgctgaagaaaattggttagcgcccgatataccacatgcaacgttggctggatcagctgctgaccgtacgattacaacgacggaagatgagtcaaaaaatgtgattacggtccgctatgatgctgtgtcaggtaagttgccagtcaaaatttttgacgacacggacactgcgaacaagattccggatacctcattgccagtagttattggacaaacgtacaactattcggttaaggatttggccaaggtcattccggctaacacccacattgtgagcctagaaaagaatagcggtacggttgctgcagatgatcaaaacaatgtgactaatgaaccaatggttattcacgttgcacacgatactaagtcagaagacgtgacgtttagtcgaacggttcactacgaaggacccgcatcactcaaggtaccggatgacaatgttcaaaaaacgacggtcacccggacaaccgataactacactgggaagacaaccacaaataagccggctgcttggctagatgttaagacgccagatattaagggttatgaaccagatatcaagaaagttcactgtgatagtattgatgcgaacccatctgagactttgagccaaacagttacttataagggcgtattcaaagtgtatgcacctgatgcgatggacttcggcacaattacaattggtgacaaatactatcaaggtaaggcgatgaagtcagctaaacaggttcacggtagcttgtatgttgcgcacaccgatgcagcgatggctaatcgtaactggtgcctaaccgctaaactcgatcagaactttatggtcggcaagccaacgctacaaattgcctatgggcaatacgaaattaatagtgattatgaaacagaaattgctaatcaatcagattcatcaaccgatggcatcacggatacggcaattaacgaaaatacacctggtatggtcggcctaaagcttgatcgttctgcacaacaatcgaacgtgcaggccgggaaagactaccacggcacaatcacttggacattagggacggtgccagcataatgaaaaaactaatggccgcgggttaccatgatccgccaacaaaaacatggtagcgattatttttgagattttttgataaaggaaagaggagatttatcatgaagaagactgtatttttggcaacgacggctatgttgggaactttgatggcagcatcaactggttttgcagcaacttacacggacaacacggcaacgactgatgcaaaggttgcatttgaggcaccaaaggaaaacccagacaagccagtaacgccaggaactgaccctgaaaacccagacacaccagaccaaccaggtaacaacggtaacgactcaaaggctttgttgaagttggtttgggcaactgattttgactttggttcacacacaatcagctcaaagcaagagtcatacgccgcacaacaattgaagactaagatgggtaactacattcctgcttatactgaagtttcagacaagcgtgccgttcaatcaggttggcacttggctgttaagcaagacactgactttactggttcaaataacaatgttctgaagggcgcttcattgaagctggttgacccaactgtttcagaattggccggtggtgcaacatcaacgattgcgcaccaagcaaacacggtatcaaagcaaaacagcacggttatggatgccaaggctggcacgatgcctggtaactacttcgcctcatttgctggttcagccgatgcatctgcacacactgataacggtgtgtcattggatgtgccagcaaacgctgcgttggcagatacttacaagacgactttgacttggacgttgactaacgcgcctgaagcctaatcaaaccactgaatagtacgaaagatctgacgtcatgtcaggtctttttttcgatatttcttcgctgagaattcctgggtggatgctactatttcaagacagtaataacttgagatggaggctacgtgatggaatggttgctaggaaaacgtgaatataagaagttacagctctttcgattcttatatcaaagtagcacgagttttaagacgttagaggaaatcgagacgcgctttggttggtcacggtatatggctgaaacattggttactgagctgattgcagatcaacaagccaaccaaattccgcaccatattcagttgtcatatgatgcgacgacgcacattgttaattggttgccaggctatagtgtgagcctggttcggatggagcgagcgtatacgctgtcatcacatgcgtttcaaatgttggttgccacgttaaaagatcgaccatactcattgaacgaactcgctaaaaaaacaggggttaatttgaaccacctaaatgacgataaacatgaattaaataagcgattgggcgcaagtggggtgcgcttaaattcagccaatcgcgttgaaggcaatgaaacagtcctacgcattatgtatgaacgattgatatttgcggcaactgatacaattgatgatattgcagattatttcacgccagatacgatgaaccgcgtgaaccaaattattgactattatgaatacacacagaataagaaattgcggcctcgtcggaattatttgctagccattacgctagcggtttgggtcgctcgtatggatgtggcttgttttattccaagagataacgattttgatgtgttagtgatgaccgaggaattgaacccgcaaatggcaacggtctatgagaaagtcaaacaagctgccgaacgctttacgaacgtaacgtctgctcatatggatcgtgaaattcgttatggtatgacggcactcattagcaatggttttttgcaggcaagtttggtggctaatgcagaacgacattatttccggttctataatgccatcatgcagattattaaagaacagtattacttgcagttccgcgttccgatgcctgcagaaacagaagatgatttaaaggtgaatctggatcgtgcgatgattgccgtgtatttcttatacaagattgactaccgcggtcacgatgaacaaatgccgttacattcgttgttaccagagtacgaacgatttacacaacaggtgtttgatggcattaaaaaacattttagcgtcgaaaaccacgaaatccgaacgcggctgtttgcgatgttttacaatgtgtttttgcatgcgattagccgggatgtcatgataccaaaaatgacgattatgttggaatttgataatccaggcttgcaaggtgaaattgaattactattgcgtcgtcgatatgaattgaacattacatatattgatgacccgacggtggcggatgctattattgcagaccatttaatgccattggcaccgtacaagcgtctgttcgtttggcagatggctccgtcatttgctgaattggatgtgttcatgcatgaagcagtgaagttaacaatgacacgatttaaaaatcaacgtgaatcatgatgaaaattggtcagggtggcaacaccttggccttttttgttggcgtaaaaccaaaggaaatataaagcgtatcgggcgtcattagggggatttgcctaagtttggtaaaatagagtgagcaaattttagacttattgaatatatagaccagatgaaaggaaaaaatacatgtatgcacaagtgattgtcgatgtaccggcaatgcagacaaaccaaccatatacctaccgtattccggctgagttaacagatattgtcgttgatggtatgcgcgttgttgtaccgtttggccgtgggaatcgcttgattcaggggtttgtcgttggtctcattgatgaggctgaagatgctgacaagttgaaagacattgatagtgttgtggaactaacgccagtcttaaacgatgaattattgcaactgggtggttggctagcggaaacgaatttttcattccgtattagtgtgttgcaaacgatgctacctaatgtgatgcgcgccaagtattcgaagacgcttcagttggttaagccagaggcgattgcggatgatgctgccgttgccttgctattcgctgatcgttctgaaattccgtttgatgaacatgagattgaaccagcgctattgccaaagttgcaacgcttgcaacgacaaggtgttttgcaggttggctatgtcgtagataatcgcgcaacggctaaaacagttttggcaatgaagcctacacaagacgaagatttctatgacaatgagcgtcgtcagttacgcaagacggcggttaagcaagcacgtttgttgacgttcttgatgacggcaccgcgcgattttatgccaattaagactgttatagatgaacaatatcttgactatccaacgattaaaaaagctgaggaacagggctggattacgcgtgacgaaatcgaagaataccgtttgccacgtttgagcagcccagttgctgcaactgaagcattgacgttaaaccccgagcaagaggtggcttatgaggccattacggctagcttgaataaagctgagaatcacacctttttgctagaagggattaccgggtcaggtaagacggaggtctacttgcaaagcattgcgcatacattggccaacggtaagacggctttgatgttagtgcctgaaatcacgttgacgccacaaatggtacgtcgtgtgaagggacgcttcggtgataatgtcgcagtcatgcactcaggactatcggatggtgaacgctacgatgaatggcgtcgcgttgagcgccacgaagtacaggtggttgtgggcgcacgttcagcaatatttgcaccgttggagaacatcggacttatcgtcatcgatgaagagcacgaagcgacttataagcaagaagagaacccacgttaccacgcccgcgatgtcgcactttggcgtgccgagtatcacaatgcaacagttgtcttgggttcagctacaccgtcgctagaaagtcgtgcccgtgcccaacgtggcgtttacacgttgctgacgttgacggaacgtgcgttgcacaatccgttgccaaaggcggaagttgtggacatgcgtgaagcaatgaaggcaggtggggatgatattttctcaccacaattgttaacacagctccgtgatcgcatggacaagcaagaacaaagtgtcttgatgttgaatcgacgcggttatgccaactttatgatgtgtcgtaattgtggttatacgccacgctgtgtgaactgtgatttggctttgacggtgcacaaggacacgggccgtttggaatgccactactgcggttatagcgaaccaatcccaacgacttgtgccaactgtggttctgaccgtatccgtccttatggtacgggaactcaaaaggttgaagaagaattgcaacgcattatgcctgacgcacgtatcatccgcatggacgttgatacaacgcgtcgcaagggtgcaacggacaagatgttgaatgattttggtgagaagaaggcggatatcctattgggtacccaaatgattgccaagggtctggattttccagatgttacattggttggcgtactaaatgctgacaccacactgggcttgccagattatcgtgcctcagagcgtactttccaactactgacgcaagtggctggtcgtgccggacgtgctgataaggagggtgaagtggtgattcaaacgtttaatcccgatcactatgccattcagttagccaagacacaggactatgaatcattctacaagcaagaaatgaatctacgtcatacttggcagtacgcgccgtacttctatacagtgcagattaagattgcccacgagcgtcaagatgaggcagccaaggttgcttatcagacggccaactggctaaagcgtcacttggcatcggattcagttttactcggtccttcgacaggtgcaatcgcacgtttgaagaataagtattattaccgaatggtgattaaatttaagcatgatgatgggttagaggaagcgctaacggaacttgtttcagccggtcaacgactacaaaagcaaggggttacgttaacgattgatcgtgacccagtaaacttcatttagaaaataaacgaggcgtttttatgcgcctcatacatataaaaaggagactggcaacatgacaactaagattgtatttatgggaaccccaaacttttctgtgccaattttgaatgcattgattgcaaatgatgattacgaggttgctgctgtaatgacgcaaccagatcgtccagttggccgcaagcgtgtattgacgccaacgccagtaaaggaagctgccgttgcggctggcattaaggtgttgcaacctgaaaagctctctggttcagatgaaatggctgaagtcattgccatgcaaccggatttgttgattacagcagcttatggtcaattcttgccaacgaagctattggaatcagcacaaattgcggccatcaacgtgcacgcatcattgctaccaaagtatcgtggtggggcacctattcactatgccgtacttaacggcgatgctgagactggggtctcaatcatgtacatggtgaagaagatggacgctggtgatgtgatttcacgtgccacgttgcctatcttggatgacgataacaccggtacgttgtttgataagttgagcctattgggacgtgacttgttgatggaaacgttgcctaagttgattgctggggatgtacaacctgagcctcaagctgaagaagatgtaaccttctcaccaaacatttcaccagaacaagaaattttggacttcagccgttcagcacgtgagattcacaaccatgtgcgtggcttgtacccattcccaatcgcgcacacgacgattaattgcgtccgcacaaagattcaacgcactcacttggttgatgaaacaacaacggcaccagccggaacggttgttaagaagggcaagcacgatttgtggctagctgccggtgatggcaacatcattgcaatcgatgaattgcaaccagctggtaagccaaaaatggacgtaacggcgtacctaaatggacacgctaagttcgaagaaggagacatggtgattactgatgagcaagggaagtagtaataaagtcgccgaatgggagttgcacaatgcacgtgccatggccattcgaacgcttgagaagattcgtaatggtgcctattcaaacttgcaactgaacaatacggttaagcaagctgaattggatgaacgtgatgttcacttgatgacaacgatggtttacggtgttattcaacgtcgcatgactttggagtactggttgaagccattcgtgaagaagccggaaaagttggacccatgggtgcgcgaattgttgtatgtctctcttttccaaatgaagttcttggataaggtgccaaatcacgctatcttcgacgaagccattaatattgcgaagcgtcgcggtcacgatggggtgcgtaagtttgtcacaggtgtcctccacgcgattgaccgtgaaggtgtgcgttcatttgatgaaattacagacaaggttgaacgtttgtctgttgaagcgtcattgccaacttggttgattaaccaattgacggaagagttgggttgggaaaaggcatcacgtattgcgatggcaattaacgatgctccggcccaatcagctcgcgtgaacttggcagtcacaacggttgcggatgcaacgaagattttggaagaagagggctttacggtcacaccttcaaaggtgacgccagatgccttgctacttgccggtggtcacgttgccagttcacaagctttcaaggatggtttggttacgttgcaagacgagtctgccatgttgatggcacctagtttggacattcaaccagatgatcaagttttggatgcggctgctgcccctggtggtaagacgacacaaattgcaacgtacttgaacgctgcagaaggtggccatgtcgaagcacttgatatccacgatcataaggttggcttaattaatcaaaacgcggaacgtttgcacgtggctgaccgtatcaacgcgcgtacgctagacgctcgcaaggttgatgaagcatttgcggacggtcaatttgaccgtattttggttgacgcgccttgttctggctttggcctattgcgtcgtaagcctgaaattcgatacgataagagtattgaagatagcttgagcttgcaaaagattcaattgggtatcttggaagcagcagcacctaagctaaaggctggcggacgtatggtttacggtacttgcacgattttgcgttcagaaaacgaagatgtcgttgacatgttcttggctgatcacccagatttcgagttggtaccaacgtacacggcctacgatttagatgctcgtgacgatcgtggtatggtccacatgttcccagatgattttgaatctgatggtttcttcattgcaacgttgcaaaagaagcaagcctagttaacaagtaaccgctgaaaggaaggcgtatttttatgaaaattgcgtatgcgtccgatactggtcgtgttcgtgccgacaatcaggattacgtgggcgtctttatgaacgaagctggtgcccaactagcaatcgttgctgatggcgttggaggcgagaacggtggggatgttgctgcaaccatggcagtttcacacattggtaatgagtggcagcaaaccgacattcatgatattgtcgcggctcgtaactggctcttaagtcaggcggcccaagaaaatgaaactattttaacgacgtcaaatcgttaccgaacgttgcgtggtatggcaacgacgctagtgattgccgtcattttggtagaccagctagtgattgctaatttaggtgactcacgcgcttatctcattcgagaggggcatttgcgtcaactgacagttgatcataacctggctagcgagctggttcgtcgtggcgcaattactgaagatgaagcagttaagcaccctggtcgccacgtgattactcgccaattgggcgtgactgaagaggcagaaccggatgtatttgaatttgcaacccgtcccggtgatatgttggttttgacaactgatggtatgccaaagcacgtgtcggatgaggaaatcttagctaagattaatgacgcaccgacaatcacagatgcagttgctgaattgattagtgcaacaaatgaagctggtggatcagacaatgtcacagtcttgatcggccgacaagaaagtgaggcacgctaacatggaaatgaatcaaatgattggcgggcgttaccgaattgtcgaaccattaggcgaaggtggcatggcgaatgtttatcgcgcccatgacattattcttgatcgtgatgtgtcaattaaattgatgcgtcttgatatgcgtgataaccaggcagtgcgtcgtcgctttgaaaatgaaatttcagcgacaactgctttggtgcatccaaatatcattcaagtgtatgattacggtgaagatggtggttcacaatatctggtaactgaatatgttgaaggcatggacttgaagcgatacattgctgaacgtcagccgattccagtgacgcgcgtcattgaaattatgagtgacatcttatcaggtgttgctgaagcgcataaaaacggcatcgtgcaccgtgacttgaagccacaaaacatcctgattgatttgaatggtcaagcaaagattactgactttggcattgctcgtgcgcagacgtcatttggcatgacgcagacgaatacggcaattggatcggttcactacatggcacccgaacaagtgaagggtgatattgcaactgttcgaagtgacatttattcacttggtatcatgttgtacgaaatgctaaccggtcatgtgccatttgacggtgaaacggcggtggcagtcgctgttaagcacacgcaggatccgatgccttcgattcgagactttgacccacgtatgccacaagcgcttgaaaatgtgattcttaaggcaacggccaagaatccattgagtcgttatacgtctgcaactgagatggcaggtgatttggcgacagcgctatcacctaatcgcgtagacgaagagcgctgggtcgatccaaatgaagatgcggctgatggtgcgacgaaggtagtgccgttagcgcaaattcaagatatggcagctaagcgtccaaagacgaattctgaaaccgaagaccagttggctgacaaggttgcaccgttgaacgatgctgcagtcacgccgaaaaagaagcgttcgccatggcgctttgtctggctagtgctcggctttgttgtggcgatggtcgttggtttggcgatttatggggcaatgcaaccaagtaaagtccacgtgccaaatctgcgtggcttaacgcaagctgctgccgagcaaacgcttaaggacaataatttgaaactcggcgacgtgacaacaaccaactcagcgacgattgcccgcggtaaagttgtgcgatcaacgcctgcagccgataagacagtagaggcaggcaagaaggttgatttggtcgtttccaagggtgtcgcgaaggtgcgctttggtgattatgtcaacgagaagtacacaacggttgctgaaaacctaaagaacaaaggctacacagttgaacagactgaggtcgccgatgatacgattccggcaggttacatcgtatcgcaaaatattgatgctgaagataaggttgtaccatcaaagacaaccgttaaattcaaggtatcaactggcgtaagccgttacacagtacctgacttcagtggtaagacacgtggaaccgttgatgcttgggcacatgaaaacggcatcagtgtcacgtataatgaaatttactcagatagtatgagtaaggatcaaatcgtggcccaatcgattacaccgggcacgaagattacgtctaacgagatgttgttgatttatatttcgaaaggacagaaccctgatgctgtgtcatcaagttcgtcatcttcatcatcgtcttcatcaagttcgtcatcttcatcaagtagcaattcaagttcgtcgagcgcaaacagcgcggcaactgaatcttctactcatcaataagattagataaagcagagtggggatgtcggaggttttagaccaacacctgctgtgacaaaaataaataggagagtaaatggcaaattatcatggacaaattcaattagcgttggcaggcttttatgacgtgttaactgatgacggagaattattccgcacacgcgcacgtggtaatttccgcaagcgtgacatgaagcctttggttggcgactgggtaacctttagtgccgatagccaatctgaaggatatattttggatattgatgagcgtgataacagtttggtacgcccaccggttgctaacgttgatcaagcaattgttgtgacggcggttaagatgccagattggtcaagcaatttgcttgatcgtcaattggtcgcacttgaagaaaaagatattgaaccggttatttatttcacgaagacagacttgcttaatgagcaagaaatggttgaaatggtgacggttgccgatggttatcgccaagctggatatcaagttattttgccagaaaaggcctttgacgagccaagtttgacggctgttaaagacatgctgagcgataagttgtcagttgttatgggacaaactggtgcgggtaagagcacgttgcttaaccacatcgcaccggaattggacctggcaacaggtgaagtttcacaagcgttgagtcgtggacgtcacacgacccgtcaggttggcttgattaagctgtttggcggttttgtggccgataccccaggattctcagcgtttgaagtattcgacatggaagcacgtgatttgacacgttacttccgcgaatttaacgaattatcaccaaactgccgcttccgaggatgtgttcacttgaacgaacccggttgcgcagtgaaggaagcgttggccgccggtcaaatcatgcaatcacgttacgacaactacaagttgttttacgatttgattgagggtcgccgcccggtttataataaacacgataagaagcactagaaaaatacgaggttttttgagatgacgattaaggtagcaccatcaattttgtctgcagattacatcaatttgcaaaaggacatcgagttgattgaatctgcaggagcagaatttgttcacatcgatgttatggatggtatgtttgtaccatcaatttcttacggtccagcctgggttaaggctttgcgcccagtaactgacatggtcttggacgttcacttgatggttgagcaaccagaacgctacattgacgtttttgctgaagctggttcagatattatcggtgtgcactacgaggcaacgccacacattcaccgtgctttgcaacaaatcaagaaccacggtatcaaggctgaagttgttatcaaccctggtacgtcagtggctgctatcgaacctgttttgcacatggttgaccaagtgttggtcatgacggttaaccctggtttcggtggacaaaagttcttgcctgaaacgttagagaagattgctcgtttggctgaaatcaagcgcgaaaagggctatgactacgacatcgagatcgatggtggtgcaaacgacgaaacgactaagttggcctacgaagctggggcaacggttgcggtcgctggttcatatgtcttcgataaggttgacccagcagctaagattgctcgtttgaaggaagtgacgtcagactaatggaacgcttgcgcctactagtcggtggtcctatctcggaatggccggaagaacttgcaaaggggacgctagccggtccatgggcggctgctgatcgtggcgcacatcgtttgttagccttaggtcacgtgccagtcctgaccgttggtgattttgactcgatgacaccaagcgaacgtgaacaaacgttggcccagttacctcgagtcgtgagtgccaagccggaaaaggatgagacggacacggaattgctgttagatatcgttgaacgcgagctacaacctgacctgattgaaatatatggggcaacaggtggtcgcatcgatcaattgctatctaatatttggatttttacgcaaccgcgttttcaacagttagcaacgaaagttatcctgattgatcgcacaaatcgtgtgtcgttctatttacctggcacacacgcgattacgcacacgccgggcatgaattatttaggattcatgccactaacaccggttacaggcttgactttgatcgatgaaaagtacaaactaactaactggcaaggtaatccattctcgttctcatcgaatgaatttgacggcgacgttaatcatttttcatttgagtcggggatggttgcggtcattgaaagtcgggatctaactggtcaaacaggcgattaattcgcaattccgacacagtttaatcgtgtaaagtaaaaatactttacacaaaacccttgcacatcgagtaagggtttgatattattattcaagtaaataaaagcactgaattaaaagagcttaagattggagggtaaacatatggcagttgatgcagtcaacggaaagcgtactcgcttcggtaaccaacgttcacacgcccttaactcaagccgtcgtagctggaagccaaacttgcaaaaggtgacggttaagattaacggttcagcacctaagaaggtgtacttgtcagctcgtactttgaaggctggtttgaagaacggttcaattgagcgtgtttaatagataaagctaccgtttacggtggcttttttctttatacacggtatttgttcagggtataacgaaattggctataaggacctatttctacgctacgatatggtagaatagatatagttttatacggaggtcatacaagatggcagttaagattcaaacaacgcaaggtgcaattgaaatcgaaaacgaggtcattgcgacaatcgttgggggcgcagctactgacaactatggtgttgttggtatggccagccaaaacccactacgcgatggtgttaaccaaattttgaatggcgacaacttttcaaagggtgtcgttgttcgtcaacaagataatggcgttgttgtcgacgtccacatcattgttgggtacggtatgaaaatttctgaaatttcaaagagcgtccaagctcgtgtaaaaaacgatttgaatgtcatgcttggtattgttgctagcgaagttaatgtaacggtacaaggtgtgcgcatgctaggagactaaaaacctagttataaggagttgagaaaagtggaagttgtaacgactattaccaacgttgaatttggtaagatgatcaacgcggcagcggatgcgctgaagaataacgcggaaaagattaataaattgaatgtgttcccagtcccagatggtgacacgggaacgaacatgacgttgtcaatggcaagcggtgctgagtacgagcgtaacgaaacggatacgcacttgggcgctttggcacaagcaacgtcaaagggcttgctaatgggagctcgtggtaactcaggtgttatcttgtcacaaatcttccgtggatttgcggctaagattgccgacaaggagacgttgtcagcccgtgacttggctgatgccttgatgggtggtgctgagacggcttataaggctgttatgaagccaactgaaggaactatcctaacagttatccgcgaagccgccgcagccgctaaccgtacggcaaaggagtcagatgacgcagttgttgtaatgaaggaaactttggatgcggctgaaaaggctttggcatctacgcctgacttattgcctgttttgaaggaagtcggtgttgttgactcaggtggtcaaggacttgttatcgttttggaagctttctacgctgttttgtctggtgaagaaatcacgactgaaattgataacgctgctttggatgcgatggtgatgtctttgcacaacgccggtgttcaaggtgacttgaaccctgaagatatccaattcggatactgcacggaaatcatggttgatattgcaaagggaacgacttacgatcaagaatttgattacgacaagttctacgagcacttggcagccatgggtgactcattgttggttatcaacgatgatgaagtcgtaaaggtgcacgtgcacactgaagacccaggtgaagttatcaactggggaacgcacttcggttcattgcgtaaggttaaggttgataacatgcgtgatcaacaagctgaagctgctgccgcggctgaagcacaaaaggaagctgaagctaaggccgaagctgaaaagcctgcagttgatttggcagttatcacgacggctactggtgaaggaatcaaggaattgtttgcttcatcaggtgcaacggttgttattgatgccgagcaagcaccatctacccaagatttggtgaatgccgttaaggaaagtggcgctaaggaagcgttgattttgcctaacgacagcaacatctttatggccgctgaccaagcagttgaaattgctgatgtgccagttaaggttgtacgcacgcgtacagtccaacaaggtttgacagcgcttgttttgggttacaaccctgaaggaacgcttgaagataacgctgaagcaatgacagctgctttgggtgatgtgaagtctggtgctgtaacgacgtctgtccgtgacacgacgttgaacggcttggagattcactcaggtgacgcaattggtttgtttgacggtgaaatcgtcgtttcagtaccaaatgccgacatccaccaagctgcagtagaattgctaggcaagatgattgacgaagattcagaacttgtgacggtgtactacggtcaagagtcatctgaagacgatgctaacaagcttgaagaagctggtttggctatcgacgaagatttggaattcgagattcacgatggtggtcaaccattgtacccaatcttgatgtcagtcgaataatagagtaagtacgaaagcgccaacacgctcggaatttccgaatgtgttggcgctttttgattacagtagatgttgttccttcagcaactcttcaatccaagtgcccttaattttcttgttgagcgcaagtttaacgagctttggcatgtgcaaatccatctcatcgagcttctttttgtctgacatgtagtagaaggctttcagtagttcgcggatatcgaatactgaaccgtacacttcaggcaccgcacggtcgacgtccattaatgtataaacggcttccatcgcagtgcgaattgagtattcggtcgtaaagacggtgtcgcggctaggcgattcagcaaagttaccaatgaaagctagattttctgaatcgttaggtacaacggctgggcgatcgccagcctcacgtggcatgaagtatgacgtgatgaacggcatgtataccggtacggtgttcacgttttcttgcttagcgagttctttgatttttacttcgggaacgccaaggtggtagagcaactcttgcgtgatttcctcaccagttgcttccacgattgtcttatcaacatagttccccttagtgtcagagtacaaaccgtaaatccaaacgaccgtctcgttttctttttgcgttttaaaatgaggctgacgatgaatcgtgaaactcatcatccagtttgaatcagtgatggtgataatgccgccggtgttgaccttgtgatcatggagactgcggtttgtgagtcgttcaatgtacggttcgatttcaggcaccttgatagtggccgtcgccgagatgaaccaactgcggtcgggcagattctcacaaaagacttcaggacggccgaattcatcagactgggcagctaggttttgccacaagcgccagctaccaccaagctctttcgatacgggtgctgcttgatggtgtgaaccataagttgagctctcggtgattgaaccgtttgtgacaaagaccaaatcgtcagctgtcaaaggaatggcttgctccgtgccgtcaattgtcaccacaagttctgtagccgtctttttgtctgcttgcacatcgacaacgacattcgtcacttgggcgttgtagacgaagttcacatcgtgtgattccaagtacttgatgattggcaaaaccattgaatcatactggttatacttgttgaactttagtgcggtaaagtcaggcaacccatcaatgtgatgaatgaatcgcattgcataacgacgcatctcaaccgctgaatgccatttttcaaaggcaaacatggttgcccagtaactccaaaaattactctcgaaaaaatcaggtgtgaagaaatcttcaagtgtttgacgtcctaattttgattcaggtgtcatgacaagcttcacgagttccatcgccttgtcatcaagttcgtacttgccatcagttgggacgcgctgtccgcgcttgtaaatgaggcgtgtgttagatgaatttggatcatcttggtccagccaataaaactcatccaagtaggaagcaccttcgatttccaaagatggaattgaacgatacatgtcccacatcgtttcgaagtgattttccatttcacgaccaccacgaatgacaaagcctacgttcggacggttgtcaccatcgagcgatccaccggggatggggagctcttcgtagatgtgaatttgacggccaggtacttgggcatcacggactaaaaagaccgctgtagctaaaccagccaggccaccgccgacaatatgagctgacttcttatcggcatcagccggcttacgtgggtgagcaaatgcttcatagttaccatttgaatatcgcatatgtatcctccataaatttcactttccatgcaatgtgttgtatgcagtcagtgtacggaaacgtcataacgtttccataacttatcggggaaagttgtatgaagcaagctatgctggcattcaatgctatataaaggccagttgagaacaatctgaccttgattttaaagttcgctatgttgcttgcgagcctggagcggtgttgtcccatacgctgctttgaagtattgcatggccagacgtttattagttagcccgtttttcgttaatagttccttgacgggttcgtcggtttgtaacaagtcttgatagaagtgggtgagacgaacctggtagatgtattgcaccggtgataaggcaatttcttgcttaaataatcggctcaaataatttggattatatgaaaacatgtctgcaagttcgctgattggtagctgttcggcgtagtggtcattaatataaccgaggacttccttgagatgatctgtttttgtttcaggtgtcgtgacaggggctgaaaacgttgtaaataacgcaaacaacatctgtaaaattgttgcctgaaaaataaaggggtaacctggaatctttgtgtcatagatatcacctaagactggaaagtagtcggcaattttttgataatcagaatcagttaaatcgagattgaaggttgtgctttccggatcgggccagtaattcttaataaagtcgataggaatctggagaacgtaagcttcgtttggcgtattactgacagcgtgaattgccccagatgggacaacgataaattgcccgtcagagatttgggtcatcgcatggttcaaagtaaacgttagctcaccgtgaatcacataaataatttctaaactgcggtgccagtgaaaaggcaccaagccaggttcatccatttttgaatagtaaaagcggaccccaacatcagggttgtgttggacagtctcgtgataagtcttttttgtcataaccctattatcaccgataaataacacaaaaacaggtcaaaaaggttacaattctcacttttgagaggtatctttttaaccaacgctcggaaatgtattgtcaatgtatccgcttacattgtactcttgttaagtaataacgaatgaagagatgacccaaaggggaatataaaaatgacaatgattcaaaatccagtaattccaggaatggcaccagatccatcaatcatccgcgtgggcgagacgttctacattgcaacgtcaactttccactggacacccggtgttcaaattttcgagtcaactgacttggcaaattggacgttgattgaccaagtgttgaaaaatggtgaaattaacttgcaaggaacaaacacaccagcaggtatttgggcaccgcacttgtcttatgatgaagcaactggccgttactggttggcatactcacacatgttgaacatggccggtcgtgagtttaactcagactcatacgcgatgtgggctactgatattcgcggtccttggtcagagccaatttacctaacgtcaattggctttgacccagctatcttccacgatgaagatgggaagcactacgtttcaattttggaatgggagtcacgtaccggttatcaagcgccaggtcacattgtgattgcagaagttgaccttgaaaatggtggtatcattggtgattggcaccgtgtgacgcaaggcttcacaacgcgcggcgctgctgaagcgccacaaatttacaagcgtgatgattactactacttgttgattgctgccggtggaacgggttacggtcacggtgttgaaattggtcgttcaaagaacgtcttcgggccatatgaagcacacccatctggtgagccaatcattacgtcttcaccacaacacttgttctcattgggtgatccagatgctggtcaattccaaatgtacaaccctaactcagtgatgcaaaaggctggtcacgggtcattggttcaaacgcaaaccggtgaatggtacatcgcacacttgatgtcacgtcctttgccagacacgacgttgaacccattgggacgtgagacgtcattgcaaaagatggcatggacggctgatggctggttgcaaatggctgacggttcaaacttggcgaaaatggaagtgccaggcatgactggtgttgaatttgagaacacggcatctgaagatattaatgaaacgtttgattcagaaacaatcgataatcacttcatgacgccttaccgtgatcaaacggcagcttgggtaaacacgacagaaaacccaggccacatgcgtatctacggtggcaactcattcttctcacaaatgcaaccaagcattatggcaacgcgcgcaacgtcatttgtttatgatgttgagacggccgtaacgttccaaccagatcactattcagaaacggctggtttgggattgtactatgatgccaacaactggttctacgcacgtttgtacaagtcagagtcacttggtacgacgacattgagcgtgttgcaagctaagttgggcgagcgtgtggaatacgtcttcagcaaggttccaatgccagagggccacgttgaattgcgtatgcattacgacttcggccgtgcaacaatttcataccgtcgcaacgctaacgaagagtggacggtgttggtagctgacatcgacgttgcttacttgtctgacgaaggtgttaacggtgagccaggtgaaattggtggctttacaggattgttcaactttattggatcagtcgacgcccaccaacacgacagctttgctgactttgactactactcagtaaaaaataactaatacaaatcaaattcggggattcattaccacggggaaattattatgaacattaaagaaattccattgcgccgattggtgccgggactaattatcggaccagcgacttggcttggaccatacatcgtagcgtcaagtttgttcttgccagctatgttgcaacaacttgatagtgtgcacaaggtgcaattggttgcgatgttttcaacgcttgcgatgattgtcgcagcgatttcaaacatggttgccggtgccttgtcagacaagacgaagtcacgctttgggcgtcgtacaccatggcttgttggtggtgcctttgccttcatgctagccatgattggttcagcgctagcgccaaatgtttggctattgttggccgcttggatgtttggacaagttgcattgaactttatcgttgcaccaatggtggcttggttggacatggcgcctgagtcagggcgtgccacggcatcatcagcttacggtggtttgggaatggcgttgggtaacaacggattcacaatctttggagccatgatgttgggatcattccgtttgggattcgtcgtattcggaattatcacattcatcggaacgttgattgctgcagcaatcgttcgtgagccatctaacttggatgccgacgatgaagcggttacgccagaagttgaagaaaagaagtcattgaaggaagctttggctattttcccagcttggcgtgttggtcgtgactactacttggccttgatgggtaagttgttccaaggtgttggaaactttgccatcacagggtacttgttgtacatcatgacggacttcatgcacaaggggacaagcgcaacgcaatcatcaattcaattgattaacttgattatgttggtgttcggtattgcaatgggattcttggctggaccatttgctgacaagttcaagttgttgaagttgccagttggtttctcaacaatcttcttggcaattggtgcgttggcaatgttcatcttgcgtaacgacatgggtatcatgatttacgccttgatggctggtttgggaatgggactttggaactcattggacaacttgctaaacttggaagttgtgcctgatcgcaaccgtgttgccttcttcttgggtgtttacaacctaggaaacacagtaacgcaagcattggccccagttttggcagccgttgtgatttcattcttcggttactcagctatcttcatcatgtcattcatctttgccatgatcggtggaatcttgattctttcaatcaagtcagttaagcgttaataataactaagacagcaactcagatttgggttgctgtctttttgtgtttgcgcatgaatcaaacccgatattcagtaaaacctaattttgcggtataatggtacatcagaaaggaaggtgttaagcatggctagtttattagatttagttgatgagcttgatggtgttggccctaagcgtgtgcaagcgctgaataaattgggcatcttcacaatcgacgacttactcggctactatccaatgcgctataacgacttagcgatgaaaacgcctgccgaaacgcaagatggcgaaaaagtaacgttcaaaggcgttgtgacatcgccacccgtggttaatcgcttcgggtataagaaaacacgcacaagtttccgtttgacggtcgaacatgacacaatcatggtgtcgtttttcaatcagccgtggattggcaagaatcttgaaatcggccaagaagttgcggtgcatgggacgtatgacaaaacgcgtcaaagtctatccggcattaaattaatgtcacgcaatggcgatgatgaaatggaagctgtctatccatcatcaaaggaaattaaggcgaagacaatcaaggatttgattatccaagccttgggtaagtatggtgaattgctacgcacggatattgtgccaagcaatttgcgcacccgttataagctcatgaatcatcatgacacggtgtttggcatgcatgcgccaaccgatggtcaggtggcgactgaagcacgtcgcagtgcgtcatttgaagaattcttcgtcttccaaatgcgtctgcaggtgattaagtcaatggaccgtgataaccgcgggcgggcgattgcgtttaataacgatgaactaaaggcctttattgcaacgctgccgtttgaattaacggatgcacaaaagcgagtggtgaatgaaattgtgcgtgatatgaaacgcccaattcacatgaatcgcttgcttcagggagatgttggttctggtaaaacggttgtggctgccttggcaatgtacgcggcgattaccgccgggatgcaagcaactttgatggcgccgaccgaaattttagcgcaacaacacgcgaaaacaattggcaacttctttgatccagaaaaggttcgcgttgaattgctaacaggctcaactaaagctgccgcccgtcgtcaaattttggaagatttggaaaatggtgatatcgatattttgattggaactcatgctttgattcaaccagacatcgcgtttagaaatcttggcttggcggttattgatgagcaacaccgtttcggggtacaacaacgtgcaacgctacgtgaaattgggatgaatcctgatattcttgcaatgacggccacgccaattccgcgtactttggcaattacagcgtatggtgaaatggatgtgtccatcatcgatcaattgccagctggtcgtaagcaaattaagacgtactggctccgtagtaatgagatggaaaagacgattgcatttattaagtcacagttgcaagaaggcgcacaggcctatgttgtcactccgctgattgaagagtcagaaacgttggatgtgcaaaatgctgaggctgtttatgctgaattgtctgagtactttgcaccgacgtataaggttggtttgctacatggtcgtttatcaaatcaagaaaaagaagatgtgatggccgcattcaaggcaaatgagttccaagtgttggtttcaacgacggttatcgaagtcggggtcgatgtgccaaactcaacagtgatgctgattttggatgcggaccgatttggtttgtcacagttgcaccaattgcgcggtcgtgttggacgaggaagccggcaatcatatacgttcctgattagtgacccgaaaacgcaatacggaattgatcgcatggaagcgatggtgggaactaccgatggctttattcttgcgcaaaaggatctggaacttcgtggcgctggtgatattttgggtaaccgccaatctggggtgcctgaattccgcgttggcgatccggtagctgacttggcgatgatgaccgttgcccaagaagaagccattgaaattgtttcgaagcctgattgggataaagatccggaactggcaccattagcagatatgttgtcagaaacaatgtcgcgatatcgtaattttgattaaaaaagatacgccttttacttttacccactcctaaaagtgtgttagatttgttctagcatttatttattaagttattattttttgtgaattcgagagggaattaatgatgtttaagattgccattgatgcaatgggtggtgacaacgcccctgaagcaatcgttgctggtgttgaactagcgcgtgaccaaatgcctgacacagagttcttgttgtttggtcaattggataaggtaaagcctttcgttaagaacaaagagcgtttgacgttggtccaagctgatgaagtgattgccatggctgatgagccggttaagtcaattcgtcgtaagaagcaaagctcattggtattggctgcgcaagcggttaagaatggtgacgctgatgcggtcttttcagctggtaacactggtgctttgttggcagccggtatctttatcgttggtcgtatcaagggaattgatcgtccagctttgatgacggctttgccagcctttgatggtcctcacgatgccttcgtgatgatggacatgggtgctaacgctgaaaaccgtccagctcacttgtaccaatatggtgtgttgggttcattctacgcccacgaaattttgggctatgaccaaccacgtgttggtttgttgaacaacggaactgaagaagacaagggtgaccaagtccacaaggaagcgcaccaattgttgcattacggctcagacaagaacttgttgaacttcgttggaaacgttgaagcacgtgacgttttgcaaggacctgccgatgttgtgattgctgacggattctcaggaaacgcaacgttgaagtcaattgaaggtacggctttgtcaatgttgaagttgatcaaggataccatcatgaacggtagcttgaagacaaagatggccggtgccatgttgaagccagcgttgaagggcatccaatctcgtttggactactcacaacacggtggtgccgtagttatcggtgttaatgcgccagttgttaagacgcacggttcagctggaccagatgccgttgctaacacgatgaagcaaatccacacgatgttggaagctgatttggtgggtaaggtacaacaattcgttgctgaccataaggaagatttgtctgctcgtccagagaatgaagtggacggttcggcctaatagcgttacactaaataacgttaaatattcgaataggaaacggaataatggaacgacaagaaatcatgaataaggttatcgaattggttgcggaccactttgaattggacccagctaaggtaaccggtgaattgaactttttgactgatattgatgctgattcaattgactttgttgaattggttttggagatggaagacgaatttggtgctgaaatttctgacgaagacgctgaaaagttgatcacgatcaacgacactgttgattacatcgcagcacgcgtttaatatttgtaaattaaaggcaaggacactttgagtgctccttgccttttttcaatcttgtgacacaacaaaaaacgtcgttataccaacggtttctctggtataattgactagtatatctagaaaggacggcttatgtttaaacaacttcaagcagaattagcacttgcccataatatccattttaatgacgtgtcattattggaggaggcattaacacaagcaaactatattaacgaacatccaaattacactggtcgcgattaccaacgcctagaattccttggggatgcggttatgcaacaatcaacggcggtgtacttgttcaagcgttatccagattgggatgaaggtcgattgacagagttgcgaatttctatggtccaaactcgcgcttttgcagctttgtcacgtgagttgcatcttgatcaatatgtccaactgggacgtggtgaagaattgtccggcgcacgaaaccgtgattcattgctcgaagatttgtgggaagcctttattggcgccttgtacctggaccagggacaagaggtcgtcatgaacttccttagtgaaattatgtttacgaagattgacgaaggattctatgatcaattcgttgattacaagtctaagttgcaagaacacttgcaacgtcatggtagcgtaaagattgcttacacgaagctatctgaacgcccagttgagaataatgaacaaatctttacggttgaggtatcggtcaacgagcaagcgttggcgactggagagggaaagtcaacgaaggaagctgaaaaggcagccgctcgtgcagcttatcaaactttgacgaagaactagggaatcggtatgaaattaaaaacattggagattggtggatttaaatcatttgccgatcgtaccaagattgaatttatgccaggaatcacaggggttgttggaccgaatggttctggtaaatcaaacatcatcgaatcgattcgctgggttatgggtgaacaatccgccaaaggactgcgtggtgacaaaatgtcagacgtcatctttggtggaacggcacaacgcgcaccacttaatcgtgcagaagtgtcaattacgttcgacaacaccgaccattatttgaattcagaatattctgaaattcgaatcacccgtacactgtaccgtaatggcgattctcgttaccaaattaacggtacgacagtacgcttaaaggatatccatgagctattcatggattctggattgggacgtgaaagtttctcaatcatttcgcagggccgcgtggaaagcatttttagtgctaagcctgaagatcgacgaacgattatcgaagatgttgcaggtgtttataaatacaagcaaaacaaagataaggctgaaaaagagctaactggtgtgcaagaaaatttgaatcgtgttcaagacattttgtatgaattggaaggacgcgttgagccattggctgagcaatcagcgaaggcgcaagattatcttgaaaccaagaagcaatttgacaagcttgaccaatcacgtttggtattggaactaacagattggtacaacgagcaaactgaaattgcccgtgagttggccggcgctgagcaagctagtgatgaacaagcgaaagttgtgaagcaacagacggacttgttgacggcgatgaaggatgagcgaacacaaacggaaacagcccgtcaagaagcgcaagataagttgttggccttgacgactgctgttgagcaattgagtggtgaacaaaagttgcaggccgagcgttcggccaatcgctcaaatgcaacgcgtgaattaaaggcgcaaattgcgcaagttgaatcacgtttggctgacttgcaggtgacggaagcgacgcgccaaaagaaggtggctagtcaaaaagcaactgcggacgaattgcgattgcagattactgaattgaccgcgtcacacccgcgccaacaagaagcagcggttagtgaggaaattgaacaagttcgtgcgaacttggttgacgcgatgcaagcgttgacgacggcgaagaatcaacagtcatatttggctcaagaacacgagcgcaatgatgctgagtctgcacgtttgcagcaacgtagcacgctgttagatgagcagattgcaacagcaacggcgaatgtgacggctgcgcaagctgaggttgacgaggtaacgaccgttttggcagatgaacaagcagaatttgtccgtttgcaaacggctggtaaggagcttgaagctaagagccaggcacaacgtcaagagtggttcagcaagatggaagaagaccaacgattgtcaacgcgtttgcagtcgttgagtcgcctatcagaaaactacgatggttatttccaaggcgttcgtaacttgattaaggctaaggataacttccaaggcattcacggcgttttggctgagctgatttcagttgagacacctcatcaaacggcgattgaaacagcccttggtggtgcgttgcaaaacgtggttgtgactgatgaacaagttggtaagcaagccattcgctatttgacagaacaccgtttgggacgtgtgacattcttgccattgtcaacgattcgttcacgcgagttgcaaccgggtcagattcagactgcacaaagtcaacctggctttatcggaattgcggctgacttggtgaagactgatgttacgtacaacacagtagtgaaaaacttgttgggtacgacagtgattgctaagtcaatggacgaagcggtaccaatggctcgcgcgttgcaacaacgtgttcgcatcgtgacccttgatggtcaagtgatgaatgccggtggttcaatgaccggtggggcaaaccgtaaccaaggtaacggtttgctttcacaacaaaacgaagtggaaacattgacggcgcaagttgcgacgttgcatgatgaaacggcaattttggaacgccaagtacgtgaaattgatgctgaattgcaaaatgtgacggcatcatttaatgaacaacaagctaaggtgctagcagcgaatgagcgtgcccaacaagcaacggccaagttgcaggttgcggaagaacgtttgacccaagtgcaaaaagagaagacggcattaagctatgaatttaatgtttcaagctctggcacggctgatcatgaaacaatggttgccgagaatgcttctgaagtcactaatttgacggagaagcaagctaagttgcaagcacaattagctgaattgaccgacgagcgcacggaattgttggctcgcatttcagatgctgatactgagttgactgaattgcgtgctgaattggcaacggcgcaagcaaatgtgcaagctgcccaagtccgtcacgaagatattgttgaacaaattgaggctgagcaagctcgcttgaacaactatcaacaacaaatgacagatttgacgtctgatcaaagtgacgtgcagcaacgtctgtcagctgaattggcaacagcaaacgctgataaagaagcaactactgaattgttgtctgacttaacagaaaagttgactgacttgaatgaacgtattaacgtggcggaggggatgcttgtccaagtgcaagaagcccaaactgatgccatgtcgacgttaagcaagttaagtggtcgtcaaggagaattgcgtgcggccattcaaaacggcgaacgtgcgttggaagaaacgtatgacacatcatttgagtttgctaaggctgaaatgtctgacatgccaattgatagcatccgcacgcaattgaagttgttgaagcaaggtttggctgaaatcggtaatgttaatttgaacgctatcgaagagtatgctgaagttaaggagcgttatgacttcttgacgcaacaacaaactgatttgattgatgcacaagataatcttcgtcaaacgatgtcagagatggatgaagaagttgagacacgcttcaaggaaacctttgatgcgattgcaacccacttctcagaaatcttcgtgaagatgtttggcggtggtcaagctaagctcgaactcactgacccagaacacttgttaacaacaggggttgatattaaggcgcaaccgcctggcaagaagttccagcaaatgagcctgttatctggtggtgaaaaggcactgacagcgattagtttgctgtttgcgatccttgaagtacgtccggtaccgtttgcggttttggatgaaacggaagcagcgcttgatgaagccaatgttgaccgttttgcacgttatttgcatgaagttaatgatcgtacccaatttattgtgattactcaccgtaagggtacgatgacgaatgccgatgtgctatatggtgttactatgcaagaaccgggtgtctcaacgatggtatcggttaacttgcaagagctagataatacgctagcagaaaattaatggggaaatgaacaatgggattgtttgatttttttaagaaaaagcctgaaaccccaactgtcaaagttgaagtgttgtacccaaacacttgggaaaatggggaagcaccagctgagccaacatcactagcggctgaagtgttgcaaccaactgccagtcaagcggttgagattgtgttgccaacgcacgaggaggttgcgccagttgtgacggaaccggtagctgaaacggaaacggttgaaacggttgcagaacctgaagaagcggttgttgcagagtctgaagcaccagttgctgaagtaacttctgaaaccaacttggacgagggattgacgaagacgcgcaagacttggtcagaacgttggaacgcctttatggctaacttccgttcagttgacgaagatttcttcgaagacttggaagagacgctaatcggggccgacgttggtgctgccacagcattgcaattgacggatgaattgcgtgatgaagtgaagctacaaaatgcgaagagcaaggctgaaatttcacgtgtgattgtcgataagctagttgaacactatcgttcacaaggtgtgaatgaagatgcgtcaatgcactttgcgcctgaaggaccaacggttattttgttcgttggtgtgaatggtgttggtaagacgacgacgattggtaagatgtctgcccgctacaaggcagaaggtaagaaggtattgttggccgctgcggacacgttccgtgcgggtgcaacacaacaattgcaagcctggggtgagcgtaacgatattctagttgttgctggtgaaccaaatgctgatccggcctcagttgtgtatgacggtgtgaagactgctattgagacgaatgccgatgtgctattcgttgatacagctggtcgtttgcaaaacaacgtgaacttgatgcaagagttggctaagatgaagcgtattatcacacgtgagttgccaaacgagccccaagaagttttgttggctttggatgcgacaaccgggcaaaacgctttgcaacaagcccgcttgttcaaggattcaactgacgtgacgggaattgttttgactaagcttgatggtactgccaagggtggtattatcttgccaattcgaaacgaattgcacttgccagttaagtgggtcggacttggtgaacaggtcggtgacttgcaaccatttgacgccgatgattttgcgaagagtttgtttggtagtttgttggaggatgagaagtaatggagctagaaaaaaacacgcgcttgaatgccttgtttgatttctatcaaccattgctgacgtctaagcaaaacgactatttgcagttgtactacgctgacgattattcacttggtgagattgctgaagaatttgaggtctcacgccaagccgtgtatgataatctaaagcgcagcacacaattgctagaagattatgaagccaagttacacttgtttgctgattatcttcagcgccaagctgcggccgagcaattaaacgactatattcaagaaaagtatcccaatgacgctgagctaactcgtttagctgaacgtttggtgacattagaagaggagtaaaccatggcctttgaaggtttgacggagcgattgcaaaacgccttgagcggattgcgtcgcaagggaaaggtgacagatgcggacttgcgcgagacaatgcgcgagattcgtctagcattgttggaagccgacgttaacttcacggttgttaaggactttgttcgtaacgttcgtgaaaaggcggctggtgctaaggtgttggaaggattgaatcctgcccaacaaattgtttcgattgttaatgatgaattgactgccatgatgggtgagtcagatgtgcctttgaacgtatctgacaagattccaacggttatcatgatggttggtttgcaaggagctggtaagacgactacggccggaaagctagctttgaagttgaagaacgaaaagaacgcacgtccattgatgattgcggccgacgtttaccgtcctgctgccattgatcaattgaagacgttgggtgagcaaattgatgtccctgtttttgagatgggaacagacgctgatccacgtgacatcgtgcgccaaggtttggccaaggcggctgaattgaagtcagattatgtctttattgacgcggctggtcgtttgcaaatcgacgaagcgttgatgcaagagttggctgacgttaaggaaatcgccaacccagatgaaatcttgttggttgtcgatgccatgactggacaaaacgcggtggagacggctgaaggctttaacaagcgtttggacgttaccggtgttgttttgactaagttggatggtgacacacgtggtggagcggctttgtcaattcgtgccattacgggtaagcccattaagttcgtcggacaaggtgagaagatggcagatttggatgtcttctatccagatcgtatggccagccgtatccttggtatgggtgacttgttgacgttgattgaaaaggcccaaaaggactttgacgaaaagcaagctgccgagacaatggaaaagatgaagtcaaacacgtttgactttaacgatttcattgcccaaatggatcaagtgcaaaacatgggaccaatcgaagacttgttgaagatgattccaggtatggctaacaatccagctttggccaacgtgaaggttgaccctaaggatatggcgcacattaaggccattgtgatgtcaatgacacctgctgagcgtgagaacccagatttgttgaacccatcacgtcgtcgtcgtttggcggctggtgctggacgtccagttgttgaagttaaccgtttgatcaagcaattcaacgaaatgaagaagatgatgagcggtatgatgaacggtaacatggccggcatggaacaaatgatgggtgccatgggtggcggcatgccaggaatgccaggtggaatgcctggtatgggcggtggcctaaagggcaagatggcaaacatggcgatgaagcaaatggcccgtcgtattcaaaagaataagaagaagcgtcgttaattatgggtcgttatttactagatgataagacgaaggctatgaacgttaagtaccaatctgaaaagaagggtgccgtttcaaaggctgataaggtagctatgttgcgtgagcaaatgctagctaagaagaataagaagtaatcaattaggtcagagattctttctctggccttttttgtcggtgttttgttcggagtttatttacagtttcatcctgaaaatatcgcacctgtcagcgatactataaacatcgatcacccgctagcgacgaagcaaactcatgcgcatgggtttgtttcacttattgtgatcacaatttgcaaaaggctcaattgtcgcgacggtgataatcgggtcttttgttttaaagagatttatcagcaatcaacgatacttttggtacggattgttggtaagtcttttattttttgaaaacgttttcaaaaattcataaattaagtgatttacattaacgctttagaaaagcaatcgtcgttatctagttgtaaactaactgtaacaaataaagttaggacatatctagggggaatacgattatggaaacacgtgtcacacacgcacgacgcacgcgaacgattgctgcgacgttggtcttgttgtttggtttgttgcttttcgctggtgttgtaacagcgttggaaacaactgcgattgctgcccaacaaagtaatgatttagttacatctgaagtattaacgactatgtcgacctcagaagtaacggctgaaccagttgttgcaaaataagaaagttaggtaagctcaggcgactgagtttatttttttgatatggtacgtgcgtatgaaacaaaagatgcaactgaaagaagcaagcaagtggtttagtatgggactgctgttggggatggtaggtgttgggctgaccattggtggaatagaaatgaaagaacgccgttcagaagcccaacgcgtaactatcgatcatgatgaaaaaaaggcattgccaattaaggtaggatcggcacaaccgcttaagctagctgatacgacggttaaagttgacccacatgtccaacatttaacaatggaacagcgtattgcgctgatgattctatctgctggcgcaactgtcgccgatgagaccaagctatatgcttcaccacaaggaaacggtgagacgtggctgcttgatgctgatgggaataaattaattgtcttaaagtttattgacggcacaaagcgaacggtaacctttatggatggtcgaaccgttgatgtcgacctgaaccaagcgtatgcatcgttacatgcgacgcaagcatatcgtgatttgacggataacatcattgttgaataactgaaagtggctattttctatttaaattttgtacagattgcgctaaaatattaacttattgcaagtgaagtagcgccttgggaccgctaaaacgttgatttttgaagaaatttcaacgtgtaaaggaaaaacactttacaggcactcaagaaactgttattataattcttgtagaaaaacaactggaggaaaataaacatggctgttaagattcgtttgaagcgcatgggttcaaagaagcgcccattctaccgtgtggtagttgctgactcacgttcaccacgtgatggtcgattcatcgaaactgttggtacgtacaacccattggttgagcctgccgaagttaagttgaacgaagaattggtattgtcatggttgaacaacggtgctcaaccatcagatactgttaagaacttgttgtctaacgcaggcatcatgaagaagttccacgaagctaagttctcaaagtaatttgagggttcagttttgaacttcttaaaagagctgatccgtttgggtcagctcttttttcatatcttaaaaatgtttggcagcctctgttcaggctctgttatttccggtaaactatttagtgtaactaaaaaaatatctttttggagataatatcaggggagaagtatgggtaaacagattaaggttattgcttgggcagttgtggtagtattgctagccatcgttggcggattcaagttttttgaacgcgttgataatggtaacgttggtatccgttatgccatttcaggtggtgtacgtgataaggcgctctcacaaggaattcgctttgttggattggactatgtgacccagtatccaattaagacgcaatctattaagcaaaaggttgcggttgccacttctgatggtaagaagacggatgtgaagattagttattcttaccacgttgatccatctaaggcagtttcaatctacaagaagtttgggtcagctgatattcacaccattgaaactggctggttggcacaaaagttgcaaaaggcagcgcgtgaatcaatggcacaatttacattgttggaagtcgttggaactgattcaacgaaggcacaagcaggtatcttgaagggcttccaaaagtcggcagaaccttatggctttgtgattgaagatttgtcatttggaacgccatcaattgatgagcaaacgcaaaagtcaattgatgatattatcaaggctggccaagacaacaagaaggctgaattggaagctaagacaaaggaaacacaagctaaggctgatgctgacgctaagattacagcagcgaacgccgaagctgaagctaacaacaagattaatgcctcaatcaacgaccaaacgattgcttacatggaggcacaagcccgcttgaagcatggttgggtaacggtgcaaacaaacgatgccatggttgatgcaacaggtaactaacgatgggattctttatttttagaattattttagcgattgcgattattgcagcagtttacatgggatacaaagcctacgaagcgtacaagcgtgatcaaaaacaacaagataagcaccatcaagaagacgatatatagttaaagccctgatgattttgcggtcatcagggcttttgtttaccattcagttgtcgtgtcgttaaacgtatcgatgtgcaagccgtcttcgtcgagttgccacgtcgtaacggaaccgttttccggttcaacacctttgtagtcaggaccagcaaaacggttggttaggttaatcaacaagataccgtgaacaaccagcagaacattatcgccgtctttgtgggtttgtaacagggtgtcgagtccgttgttaatacgtgtccaaaacatattcgcatcctcggcgtcaccagccggatcagcctcgcggaatgcgtccatcagctcattgctgtccatgctttgaatcaagtcaccgtatgtcgtatcagccggtaaaccaagtacgttagctaactcatgaccagcttcaacaccagatagcccgtcgcaagaaccgaaaaattgttcgcggaaatcaggtagttcaaccaaatcttggctgtcgccagttagattggcatccatcacataacgagccgtttgtgccgcgcgggctaggtctgaagagtagacgccgtcaaagtggacgtgacgcagacgttcaccggctgcttgaccgtccgcaatccctttttccgttagcggtgcgttggtccagccttgcatacgacgatacttgtttagataagtttggccgtgtcgaaccatatagacatttatgctcataaaaatttatcccccgtgtatatgcctttagtttagcaaagatggtcgaataattcttgtttagttgggataaaaattaaggtatactagaagttagcaaattaaccgaaaactttactgtaatgggtaaagatgaaactagtattaagaggaagactgatattatggctttgtacaaagtaggaacaatcgttaatacacacggtatccgtggtgaagtccgtgtgattgcaacgactgactttcctgaagatcgtttccaaaagggcagcaagttaatcatcgatggcaagacgccagttgaagttgagattgcaacggttcgtaaccacaagcaattcgtgttgttgtcattcaaggatttgcaaaacattaacttggttgagcaatacaagacgcacgatttgatggtgcctgaagaagcactgcaagacttggcagatgatgaatactactaccacgaaatcgttggtttggatgttgtagacaatgcgactggtaagacgcttggtaaggtagcagaaatcatggaattgccagccaacgatgtttgggtcgtgaaggccaaggggcaagatgatattttcttgccatacattgaaaacgttgtaacggaaattgatcttgatgcaggtgttgctaaggtcaacatgcttgaggaaatttaatcatgcgcattgatgttttaagtttattcccaaatatgtttacgccaatgcgtgaatcaatcatcggtaagaccattgaacgtggcttggtagattttaaggtgacggacttccgtgactatactgataacaagcacaacaaggttgatgacgaaatttatggtggtggccaaggcatgttgttgatgccacaacctattttcgacgcaatggatgccattgagtcagaagcaggttcacgtggtcgtgttattttgatggacccagctggtaagacgttcaaccaagagatggctgaagaacttgctaaggaagatcacttgacgtttattgcaggtcactacgaagggtatgacgagcgtattcgcgatttggtaaccgacgaaatttcacttggtgactttgtactaactggtggtgaacttggtgcgatggtggtcattgatgccacggttcgtttgttggatgaagctttgggtgatcaaatgtcagccgttgatgattcattctcaactggcttgcttgagtatccacaatacacgcgtcctgctgatttccgtgggatgaaggtacctgatgtgttgatgtcaggccaccacgctaacattgcgaagtggaagaagaaggaggccttgcgccgtacgtatcttcgtcgcccagatttgcttgaaaactatgacttcacaaaggaagagcgtcaattgctcaacgaagtgaaggatgaagaagcgaataagtaggattaatacttgttaaaggacaccagagatgatattattatttctggtgttttattcaccaaaaaataaacccgataatccgctggccaggtggtgaaatgattgtcgactaggagatttgattatgcgtcaaaacgctttgctagaaaagttggttgctgatcaattgcgtacggacattcctgagttccgtgccggtgattcagttcgtgtccacgctcgaatcgttgaaggttcacgtgagcgtgtgcaaatgttcgaaggtgttgttatcaagcgtaagggtactggcatccaagctacgtacactgttcgtaagatttctaacggtgttggtgtggagcgtacgttcccattgcactcaccacgtgttgacaagatcgaagtgactcgtcacggtcgtgtacgtcgcgctaagttgtactacttgcgtgcattgcacggtaaggctgctcgtatccgcgaagcacgccgtgcctaatgacattacgtcattaagcaataagaaagctgattccgtttggaatcagttttttttgttgcatttcatgtatatataattagtaaaacgtttaatgataaaaatataattttattagggttaatttcataatttgttatgaaaaaggcatgaaatagtgtaaactataacgagtgatattttctataaggattgggttttcatataatgagcgagcaaaaaacaaagaagcaaaagcgaagcattgggcttggctggcgtattttgttagggctggttgtgggaattattttgggtgtgattttctaccaaaataagactgcgattacggccatgcaaaatatcggatcaatgtttattggattgattcaaatgattgtgttgccaattgtgttgtctagtttgacggcgggtattgccaagatgggtgatatgcacaaactaggccgtatcggtggtaagacgattatctacttcgaagtgttgtctacgttggcgattgtcattggtttgttggctggaaacattttccaaccaggtgcccatgttgatattcacaacttgcaagcgtcaaacattagttcatacttgagctccgctaaggaagctggtgaacacggtgtttgggcaacgttgatggatattattccaacgaacttcttcggctcattggctgaagacaaaatgttgcaagttatcttcttcgctgtattctttggtttgggtacagcagccatcggtcctaagggtcaaattattattgacttcttggacgctgttgccgaggtgatgtttaaggtaaccaactgggttatgcaagttgcgccaattggtgttggtgccttgatcggtgcaacagttgctcaaatgggtgttagctcattggggtcacttggcttctttatcttcatcgcctacgtcacgatgattttcttcatcttggttgttttgggtggtgtcttacacttcttcggtgtcaacatttggacattgatcaaggtgttgaaggaagaaattattttggcctttacgacggcatcttcagaagcaactttgccacgtatcgtgtcaaagatggagaagtttggtgttagccaaggtgttgtgtcattcgttgtgccaactggctacacgtttaacttggatggatctgccatttaccaagcgctgggtgcgttgtttatggcccaagcttacggcattcacttgtctattgaacaccaattgacgttgttggttgtgttgatgattacctcaaagggaatggctggtgtgccaggagcatcattcgtagtgctgttggcaactgtttcaactattggtgtgccagtacaaggtttggcctttatcgctggtattgatcgtttggtcgatatgggtcgtacagtggttaacgttgttggtaattcagctgcatcaatcgttatttcaaagtcagaaaaggactttgacgaagaaaagagcttgcgttatgtcgcagcaatgaacgactaaaagtgatgacggaatcttgctaatgcaaggttccgttttttggtagtttgaagtgtttcaatatgttgtcaaacctgacatctagtgtggtctaaccatgaaaactgtgtgataatatagggacgattaaaaaacgacgtaaggaggcggcacttgtgaacattgcacgtgtacgtgagtatggactaaaggcaattgtcttcgtaacagcatcggttttggttgctatttcgatgaataatttctttatcccaaataatatcttctccggcggatttaacggagttgcgcagctgcttagtttgttctttaaagcagtgtttggtatcaatgttgaagttggagccattatcatggctgttaatattccactagcaattgccggttggatttacgctggacgagaatttacgattctatcatttttgaataacttctttgcgtcgttcatgcaaattatgttgccgaagcaaacgctggttgcacatgagccaattttggctggtttgtttggggggctgctactaggggtggctattggtatcacgtttaagttgggattctcaacgggtggtatggatattgttgcgatgattgtccaaaagacgactggtaagtcaattgggttcatcaacttgtttattaacggatttgttgttgtcatcgctggttcatttattggttggcaaaacgcgatgtacacgattattggtatctatgcgacgtcggttgcggttgattcaattcacacgcgtcaccaaaagctgacggctttcattgttacgaagcgttctgatgaagttgttaaggcacttcaagaagatttgattcgcggaattacgattttgccttcagtgggtgcgtacacacgtgaaccaaacacgacgttgatgatggtattgtcacgttatgaattaactgagatggagcgtttgacgaagtcagttgatccagatgcgtttattaatattgttaatacagttaacgtctcaagcaatttctggaatgaagatttgcagagccaaattcgccgtgagcgactagcggcacaagcacaaattaccgaggcattgaatttggatgctgaggctgataagctaatgaataagtagaaaagaaagaggacataataatgccatttgtacacgtagaattggttgaaggtcgttcagacgaacaattgaagggaatgatggctgacatcactgcagctgttgaaaagaacactggggcaccacgtgaggccatcaaggttatcgttaatgaaatgcgcgctgaccgtttcatggacggcggtactttgcgttctgaaaagtaattgcgtacaataagagaggtggttttaaaaaccatctctctttttttacgcaatggggatgcgtaagtaataaacgaattattaggagcttttatggctgatcaatttatcatggcccttgaccaagggactacaagcacgcgtgccattttattcgatgaaacaggtacggccattgcaaccgcacaaaaagagttgccacaaatctttaagcaaccaggctgggttgaacataatgcgatgacgatctgggatgatgcccgtcaagttatggctgaagtcgtcattaaggctaatgtgccaccttataaggtggctggtatcggtgtcacgaatcaacgtgaaacaacggtaatttgggatcgtctaactggtgaaccaattgccccagcagttgtttggcaatcaaagcagagtgacgcaattgcagaacaacttaagacggacggtttgacggactgggtttacgagaagacaggtctttggattgatgcctacttctcagcaacaaagattatgtggttgcttgataatgtgccaggcgctcgtgagcgtgcagaacgtggtgagttgttgtttggtacgattgatagctggctgttatataagctgactaatggtgcagtccacgcaactgattattcaaatgcgtcacgcacgatgctgttcaacattcacaccttgtcatgggatcaagaattgttggacaagtttaatattccagcaagtatgttgcctgacgtcaaggattcatctggtgtatttggttatacggcggattatgcattctttggcattcaagtgccaattgctggaattgccggcgatcaacaagctgctttgtttggccacaaggcctttgaagctggagatgtgaagaatacgtttggaacagggtcattcattgtgatgaataccggtgatgatatcgcaacgtcaaagaatggcttgttgacgacaattggctatggcttgaacggtaaggtgacctacgctttggagggatcagtctttattgccggtgccgccattcaatggcttcgtgatggcttggaacttatcaagagtgccaaggagacggctgatttggccgaggtggctcgtgaacaacaccctgaaccaatttaccttgtgccggcctttagtggcctaggagcaccttattgggaccagaatgttcgtggtgcgatgttcggcttgacgcgtgcaacgacaaagggtgacgtcgtgcgtgcaacattggagtcattggcttaccaaacacgtgatgtgttggatgctatgcaaactgataccggtttgacggttggtagcttggtaattgatggtggagcagcagccaataactacttgcaacaattccaagcggacttgattaacgtgccagttcgccgtccaaagcaacttgaaacaacggcccttggtgccgcataccttgctggtttgggtgtgggttattgggaatcaatggacgcgctaccagaacaagccgccactgaaatgaaagagccaatcgctgaacgccaaaacgaaatggctgaggcctattcagggtggcaacgcgcagtgaaagccgcacgtatgttccctttggactaggctgaatgcaatgtaaacttgataagtttgtaaataaataattgcaaagtatatgagcgttgcaatacaaatgaaataatgaaaatgacgattaagacgaactgcctgtgacacaggtgacgtttagatcgtcatttttgtttgatttcgtgcacatttgcctgtgacacttttttgattggcgtgatttttctaaattttaccaaaacatagattttgtatttgacatcgaaaattgtgaatatttctatcagaacgtttgttcccctaatttttaaagtaaaagtagggtattatagagtagtcgagatattatttaaaactttcttaacactttttctgtagacgagagtatataaatcctgagaggagtagttcatatgggacaagtatcaactaaagcaatcgttgctggtgttgctggtgcgctaggagttgtcgcaacaacgcaagtgccaatggtacaagcagcggttgatcaattagcaaacatcacaactgattcagaacatgttgcgacgacacatgaggcgtcagctgttttgaccaatgatgataagcaagtaacgacgaagtcagatgttgtgcgcgataaggtgttggcaacatcaccaaagatttctttgcgtgcagttactgatgttgcaccagtagcgtcagcaactgataaggtgggggatatcgagttgctagctaactcggaggctgtatcaccttcatcagcgacgaccgtatacacgccagcggcgtcttcagtagcggaaagcgcagcggtgacgccggctgagcaagctgtcgtatcagaagctaaggcaacgccagagaagccagctgacacaatcacgtatacgattaaggatggtgacacgctaggtcaactagctgcgcaatacggggtttcagtggaggctattcaagccttgaacccaggtgttgatgtcacaatgttgcaaattgggcaaaccgtctttattccagcagcaggggcaacgattgcgacaccagtttctgatgtggcatcggaagttgctagtgtggcaacatcagaagcgccaacagtggctgattcttctgttgcttcacaagcaccagttgcatcagaggcaccagttgtttcagatgcaccggccgtttcagagacgccaaccgaatcatcagtagttgcatcagaagcgcctgttgaggcaccagcaacctctgcaacgccagcacaaccttcagaggcgccggtctcagaagcgtcagttgcgtcagaagcaccagcttctgattacgtgaatgcaccggcagctgtgcaaggtagcttgacggcggcacaacgtacggcaattgttaacgcagcattgaagtacgctggtcaagatattccatacgtatggggtggtaagacaccagctggttttgattgctctggcttggctgcttgggtatttaatgatgcggggctaacgcttccttcatatacggttacggaagagtcatacgtctcaacgactgacgttaagacgccagctgacgtaatggcggttgcccaaccaggtgacttgttgttctggggtggtcacggtgcttcatggcacgttgcaatttatattggtaacggtcaatatgtggcagcaccagcaccaggttacaatgtccgtgtggaaaatgtgacaactggattcatgcctgactttgttggatcatataacgcataatattaaaaacacagatgattagtcgtctgtgtttttttatgcacaaaaaagccgttagcgcagtgctaacggctttttcaatcgttacttaacagttgcatcaagttcagccaaacgggcgtcaatcgtctctaggacggcttgacggttggctgcatcctcaaggtcaaattgttgcaagtcgattttaatctttggtgaagcatcatattcttcataccacttttggtatgcgctccacatcttgaagtagtagctacgcaattcgtcattatcttcgaattgttcgtagtcacgaccacgcttcttgatacggtacaagatcgtgtcaaagtcagcatcggcgaagaccatcaagtcaggacgtcccttttgcatcgtttgaatttcggccatcatgttgttcaacaaagtcatgtaaacatcaagttcggcgtctgaaatgttaccttcgcggtggttctcttgtgtgaagagggcatcttcataaattgaacgatcaaggacattgttgtcgtcggtcaaggccttcttaatcatcgcaaatcgcttgttcaagaagtaaatttgcaataggaaaccgtattgctttggatcagcgtagtataggggcaaaaccgggttttcgccaactggctcaaagaatgcttgcgtccccaaatgctttgcaatcaaatcagtcaatgtcgtcttaccaacaccaatcatacctgccgtgataatcaccatggtagtccttcttccttcagaattttgtttcaagaatcgtcaactacagcataagctgagttgaataactgataactatcttagccaaaatatgaatttaattcaacgtcttgacaaataaaaaaagaatgccaagtagggataaaccccaccgtttaggcattccttagaaagtgaataaaatatgtctattttatgtcgaagatatcgttcgggtttagtccttcttagcggccaaagcgtcacggatttcttgcaaaacgccaagctctgtttcggtcgttgcttcttcctcttcttcgacttcctttgacgtcaatgcttgtgccttacggatagccttcaaaatcaagaagaccgcaaaactagtcaacaagaatgtgattaacgttgagatgaaagcaccaatcttgatgtcggcagatcccacgtgccagacgatggctgaaaatgagattgaccccgtgacaataccaacaagtggcataatcaagtcatcaacaactgatttaacaacagtttggaaagcagcacccatgatgaaggcgacagctaggtccatgacgtttccacgcataataaagtcgcggaactcattaataaaattacgcatctgaatactctcctataatccttttgttactctgattataactgtttcagaaatgtgacagcaagcaaaagcatttgaaaaacaaagtaaaaatcaaataattattcatgaattggtaataagcggttgcctttatttgttacaatagggataaacacacgggggataatacaaatggtatataaaatgctagtttcagacttagatgaaacattgttaaatgatgatggaaccgtccacgaagccaatttggcggcaattaagcaagctgtggcggcgggatttaagtttgtgcccaacactggtcgttctttcaagtcagttcaagagctgttaaagactttggggctatatgatcaagctgggcaatatgttatctcatacaatggggcagccattgttgaaaataaagacaaccaagtcttgttgacgcgtggtatggatcttgcgcttgctgagaagatttttaaggccggtttggtgaacgagacggtcgatgtgcacgtttacacggtcgacacactattcatctacaacatctcgccaactgataagcaatacatggctgagcgtggtgtgccatatgaactaatggcgacggatgacttggcattcttggctaatgagcaaccggttatgaaggtaatctttgaacaccctgatgaggctgtgcgcgaacaaattcgtgatgcagttcttgcagcggttggtgccgaccaagttgaagccacattctcatcttcacgttatgttgaatttaacaagaagggtgttgataagggatcagcatcattgctgttgggtgagaagctcggtattgcacgtgatgaaattattgccgctggtgataataataatgatttgaagatgctgactgctgtgggactaggtgtcagtgttgcgaatggtattccagcaattaaggaagctgctgatgttgtgacgacgaagacaaacaacgaaggtgcgattgcggaaattcttgaaaaatacgtactgtaaggataggtaaataatgggattagcgttgcagattggcacgagtataattacggtgctactttttatcgggctggcagcagtcgcgaaaataatggcgtggccactctgggtgtcaatcccagtattcttgctcctattcgtcttgatgacagttgtcatgtcatggttgacggtaacgttgcgattaaaggcggaaaagaaggaggaagaggctaatcatgactaaagaacataactggattggcgatattatcacgggtttgatttggattatcgtaggtgttctgttggactttgcgattcaggtagcggggatgtacagcgcacgtagcatggctagcttgctacatgtttcgccaaatagtgccggtccgattataacgatgctattgtttttggcggtctttacgacaattgcagtattagttgtgggttacggtgttcgtcagcgatcacctaagatgggcttacacaaatttaacgggcataaagccaattggatttggcgtgggtacttgatgattattggtgctggcgtggtgagcgtgctcctgcaatatgttttcgcaggcggtgtacaaaccgcgacaaatcaacaggcgcttgaaaaaatggctagcgcgggtggtgcaaacttggtgtttgtcatcttgttagctgttgtcgtggcaccgctagtggaggaattgatcttccgtggcatcgttctgaactacttctttaaggatggaccatggtggctgaatgtcgtgatttcaggtgtgctgttcgggtatttccacgtcttccaagatttccaaattttcgcccttattcaatattcactgatgggtgtcgctttagctgtggtttataagaagacgaaacaaattcaatattcgatgatgacgcacatgcttaataatgccattgcgtcattgtcattaatctcaatggcgttgcattaatcgttacaccgtgtgtttcgaaaatgcaacataaaaggtgttatgcaagctccctttatcagtgcatattcgcttgtttttagataaactaatacttgtaattagtaagtatgcgaatataaataagcacggaaagaggatttggcacatggcattcatggttaacttgaaggaagtttacatcgacccagcagacgttgaggcttacttgacggaaatcgctaacctttggcaaggtgaagaagacaactacgagaacgaatctgtaacgtcacaaattatggactttgtttacaacaaggacacggatgacgcacactttacgtttgaaaaggccgacgacgagttggttatgcgtaagggtaaggacttttaccaattgatccgccaaattcgtacgaaggttgattcagaagtgcctgctgatgttacaccattggtcgcacaaacaatcaaccaaaacgttcaacaaaacttgcgtatgcgtatgcaaatgcaatcaggaccttttgcacaaacgacgtcacacggttacatcgcccgtcaacaatcagaaggtaacaactaatagaagagggaccggcatattgccggtcctttttttgaccaataaagctgaaattattctaagattaaatcaaaagatgaggtgatgaagatgtatattgaacttgatgactacgcaacgaaccgtgtgatgaacaactttgatcccgagacccaagtgattttgttcgcggtggaagatggtattagcccatacaatgacccactagatgtcacgatggaaacaagctttacgattaacatcgttaacaaggatgtcccataccaacgatggtttgatatgccattggaaaccagcttgggtacttggtacatcaagagcacgtcaaagtctttgctagctgaaaacatgcaacttcgtaagaagaataactttggtggtttggcgcttgattcaaatgaacaaggccgtttggtcgagagtgtggctgttaaggatgcgactggcgttgatattgccgcatacgatgctaatcaaaacggaccagaatataagtaaagcggatagttttgacgggtatttttgatataaattggttataatgtttttaatctaattggggaataatgtggaggaaaacataatgactgaatacttacatgtcgcctttggttcaaaggcagtgttgcaaaatgtgcgtaacgaacacttggatcacaagttgttgatgatggttgatgatgaagataagtctcgctatcagttgcttgaaaagacaacgaataagaagtcgatttttgcaatgccaacgacgtatgaaattcttgctagtcgtggggaaacgagcgatattcgtggctggatgaattttacgttcatcacattgaatgatgcagaacgtgataacttcattcgtcgttataacgcatatgaagaggggatggatgagcacggctttatcagctcattcttgttgcaacgtaacgataatcaacaccaaattgtgatgctatcaacgtggaacatgaagtctgactgggagctatggcatgccaagaatgacttcccactccgtcaatatgagagttcaaacagtttgtacggtttgatgcgtaagcaatacagctttgccgcgttctcaaagcaaaatatgtaaataatctattcaataacaggataatttgatatagttatactgttattgatatgccgccgtggcggaactggcagacgcgcaccgttcaggtcggtgtgagagcaatctcgtgcaggttcgattcctgtcggcggcatatagaaaaggatgattctcataatcgagaatcatccttttttcgtaaattactttagcccttcagcgtgcttactggttaacttgaagtcgcctgatgtggttttcgcaaaagtcagcgtcacagtttttgttttattcgcattacgccaaattgccacgcgtgtcgttggggatgcggacgtgtcatcttcttgttcgtttggcttgcccgagcatgtcacgaatgtcctgataggtgtcaccaccacggccggttttgctatcaccaacggtcagattatcaaagtcgccgcgaacccaatcaaatccatcagcctgcttatcgtaaatgtgcacagacaaatgcttgctttcgtgactgattgaattgccatagtagttttggttaatacttactaagccaatgcctaataagctcaataatgccgtaataattggtaatgtcttatcgccatgtcgatctagccatagagcgaatagggcgaatgcaaaagccagaatatcgaccacgagcccaacgtgattgatcacgggaatccatgataacaagatgccaatgaacgcaatcgttaaggctgcaatttttgttttgaagtaaggttgttttcctgtcatataagttaagtctccttttttcaaaactttaccgtatttattagttgttgactgacgctaattttttaaaacatgaattggcgattggacaaagtttgtttcagactatttgtttgatatgatggagaaaagaatcgcgagggtgagttatgaatcgaaaaattattgaaaaaggttacgccatcatccttgatttggcgatgctggtgctgggtattgtgatgattgggttctttgtgaaagaactctgggaattagtgacaatgttgatgcatgttgatttagcgacggatttctttggtgtagcggaacgcatcttggaaacattcttgttcttcgagtttgtcgtgctaacacgtgagtactttatccaagatcgcatttctctgcagaactttatgtatattgggattactgcattgctccgtaatctattggtatatcacgccgacacgattggcattttgattcaagcagctgcgattgcaattttgattctagtgttggttgtttaccgctggtcacgtcgctatctagcagatttagcgcaccgtgaagagcgtgaagagttggtatttgctgaagagcatcccgatgcaacgaagtaggtcaatgacctgctttttttctaccatgacaagagttgtcgattgcacgtataatagaaataggtgcattcgagaggataagaaaaatgctggatttagataaaattccaaaaaagacattaaggcgcagtaagtggctaaccgttctgatgctgtttttagcgattgggtttacgccagcctatctagatagtatttcaaatgtgttggtgttcgcattcctggttagtttggttactaagccaacctttgtatttcgttggctattaccattaatgctaatcggtgttgcctgggcgatcccaggaattggctggccagtgcaacttttgctatcaggtgttgttctggtttttcgtcaagtggtgtttacgccgatgaaacagaccaagcaacggattacgaccgcaaaacaaaaagtaaccattaatactgataacctgtcgaagcgtgatgtcactgtgtttaaagcaacgttcaatcggacgctggccagtgttgatcatgtggaagaattgttgcagttgacaacgggattgcgtaaaattgcgattgagaccgatgtgatgcggtttgcgcgtggtattctgaaagaattagctgatgatccaacccaattaacagaagcagatgagtttgtttatacacatttgccaaacatggaacaaattctggtcacgtatcaagaaattgcaaaccatgaaatgattgatgagtcggacaaagcacacttgaaggcggcacgtgaagtgttgcgccaacttgctgaccaaattcaacaagactaccgtttaatcacgcgcgatgatttaaactcacttcgcgatcaaattgatgtggcgaagcgaactatgggggataaaaaatgacagaagaagtaatgacaaaagagacggtgacgacacccgagttatcggatacgttgacgtctgaagagaaatcaaaagcgctgcaattggcccaaacattggatgttgcaacgagcgattcagtgttaacgtacggtgcagatgcacaaaagaacctctctgctttctcgcaaggtgtattggataaggttcaaaatcaagatgtaggcccaattggtgattcgttgactgagttgatgaataccttgaatcaagctagcccagatgatttgcgtccggaaaagcaaggattctttgcccgtatctttaatcgcgtccaaaagtcagtctatgaaatgacggctaagtaccaacaaattggtgcccaagttgataacgtggctgcgcgtttggatcgccacaaggattcattgttggctgataataagatgttggatggcttgttccaagaaaacctcgacttctttaaccaattgaatgtatatattggtggagcggagatgaagttgagcgatgtccgtcaacgtgaattgccagctgcccaagaaaaggcacgccaaacgaacaatcaacttgatgtgcaaaaggtacaagatttggtgcaatttgaacaacgtttggaaaagcgtaccaacgatttgaagttgactcgtcaaattgcgctacaacaagcaccacaaatccgattgatccaatcaacgaatcaagtattggccgaaaagattcaagcatctgtttcaacggctattccattgtggaagaatcaagttgcgattgcgttgacgttgttgaagcaaaagaatgcggttatcgcacaacgcgctgtggctgatacgaccaatgaacttttgcgtgccaatgcagatatgcttcaccaaagtgcggttgaaacggctaaggaaaatgagcgtggtgttgtcgatattgagacacttcaagagacacaaaacagtttgattgcaacgattcaagagacgatgcaaatccaacgcgatggtcgcgcaaagcgtgccaatgctgagcaacaaatgcaagtgatggagaacgagttgaaggaaaagttgttggggatggccgaagaacaaggccgaaaagacattaattaaaaaattttttcgcggacattatcatagatgtccgcgttttttatcacgataaattcacgttttgcgctgaaattgaggcggcatgaaataaatacaaaaggatgtgataactgtatcatttcgtgcatgaaccccattaaaacaatagcgaacaagtaaactcggccttaatcattttttaataatttgtggtcgtgatagacgatttggttgtcatgtttctgtaatttgttcgcaatttttcgtaaaaatgggggttacatgttcacatattgacggttataataggagccataggtagcagtaacaccgtagaagccggaaggaggcacatatggtcacgttatatacatcacctagttgcacatcatgccgcaaagcgcgtgcatggctcgaagaaaacgccattccctatactgagcgtaatgtcttcaaagagccattgagccgagatgagattaagaacatcctccgaatgacggaagatgggaccgaagaaatcatctcaacacgatcaaagctatttgctgaattggatgtgaagctagatgacttgtcattgagtcaattaattgaaatgattcaacagcaacctgcgctattgaagcgcccattaatgattgatgaaaagcgtatgcaggttggttacaatgaagatgagattcgtcgcttcttgccacacgaggttcgtcaacaagaacttaagcgcgcaacgctcatggtggatttgtaacatcccaacccatacatagaaaatgaggctactgggtgtggcctcttttttagcccgaattggtggttaaaacactaatatatcgactattaatcagtaactttgttataatggttagcaaagataagttcccgagtagcgggaagggaaggggtgcccaattatggaaatggaacgcattaatgaggatacaattcgagttgtggtgacaaacgacgatctcgcagaacgcagtatctcagtgatcgatttgctgggcaaccaggaagaaattgaacgtttcttctacaatatcttggaagaagttgatgttgagcacgattttgaaaacaatgaggctgtcactttccaagtattgccaaaccgaaatggcttggagttgtttatttcaaagaacattggcgataaggccatgatggatggcgttatcaactcaatgtttggaaatcgcgatgcgggcgacgtaaacgatgatgtttcagacagtttgttggagcaactactagataacgatggaacgaacgaccgtaagccaaaggctaacagtcgtgcccgtgctgaagaacaagctgctaaccaaatggttaatgcagctcgtgaattggcacgtgacaagcaaggtcgtcgccaagttatcttgaagtttaacgactttgaagcaatcatccaattcgctaagatgatgcaagaagaagttggtgattcaaagattattgaatacaacaaggcttactaccttgagttgtcatttgatgattcagtgtcacaaaccggtttgcaagacatcaccgcggtagcacgtgagtatggtgaagtcacgccggtagcagcagaagtgcttgcagaacacgggcgcacgatcttcgctgaaaacgcattgacgcaagtgttgtcatactttaactagaataaagcccaaaagcacacaaccgatttttcggttgtgtgcttttttgttgtgcactccgaccgtgagggatgacacaaaccaccaactaacaaatcaaattactcgaccatatacaaatcttataaattaaagaaaaagaattacgccaaaaacacggtttgttgcaaaagttttacaaatgaaaaggtgggcaatgtatcatatggtaatgtgcctcatttggtggtaaacgctttcattgttgccgttttaggcttgttcataaaaaaacctacaacttaatcacagactataaccgtcagaattcataatttagtctttttgttcgaaacttttacaaaatatatctgtaatatagttgttacaacgaagcagtaaattgtgtttgtaaacgcttacattaattatttgcgacgttgggttttcactttacgtaaccgaatagggggatattatgggactaaagttgaatgatgatttcttgtggggtggtgcgattgcagcacaccaagccgagggtgcttggaacgtcggtggtaagggtgtctcaattgcagacatcttgactgccggtgctcacgggaagccacgtgaaatcacagatggtgtgatcgagggattgaactatcctaaccatcacggtatctacttctatgatacttacaaggcggacttggctttgatggccgagatgggctttaaggcattccgtacttcgattgcttggacgcgtatcttcccaaatggcgatgatgcaacaccaaacgaagaaggattgcaattctacgatgatatgtttgatgaaatgaatcgtcttggaattgagccagtcatcacattgaaccactttgaaatgccataccacttggtaacggaatacggtggttggtctgaccgtcgtttgatcgatttgttcgtaaagtatgctgaaacagttttcactcgttataaggacaaggtgacttactggatgacgcacaacgaaatttcaaatcaagctaacttgactgacgaaacgatgggcgaattcatgatctggacgaattcaggtttgaagttcccagaaggtacaccagccgaagacaagttggcagccatggttcaagctggtcactacgaattggtagccagtgccaaggctgttcaaatcggacatgcgattaaccctgattttgtcatcggcggtatgttgaacgttgcgccattgtacccagcttcatcaaagccagctgacatgttggcagtgcaaaaggcccgtcaagcgcgtgactggttctcagatgttcacgttcgtggtgagtatccagcagaatttgaagcatttgcaaagcgtacgggaatgcgccctgatattactgaagaagatcgcgaagcacttcgcgccggaacagttgattacttggcaatttcttattacaactcattcgtgattaaggcaacatcagatgatgatgcagaattcgataacctacatggttatgaaattgtgcctaatccggaagtgcaagtttcagattggggttgggcaatcgacccacaaggcgtgcgttacacgttgaacgaactgaacgacttgtacccaggtttgccaatcatgattgttgaaaacggctttggtgcttacgacgaagtagttgatggtaaggttcatgaccaataccgtattgattacttgaaggcgcacgttgctgaagttgaaaaggcagttgtgatggatggtatcccagtaatcggttacctatcatggggaccaattgacattgtgtcagctggaaccggtgaaatgagtaagcgttacggctacatttacgttgatttggatgatatgggtgaaggttcaggcgaacgtttgcgcaaggattcatttgattggtataagcaagttatcgcctcacatggtgtggacttgtaatttaattctaaaaaatttttattaaaggtatttctggaggaaataattatggcagacaagacgattatgttggcatgtgcggcaggaatgtcaacttcaatgttggttaagcgtatgcaagatgcagctaaggctgaaggtaaggactacgagattttcgcaaagtcaacgtcagatatcgatgcagaattggcatcagatcacaagcctgacgtattgttgcttggacctcaagtcggttacttgaagaacgatgttaagaagaagactgacgaagctggtattccgatggatgttatcaacatgatggactatggcatgatgaagggtgacaaggttttggcagccgccgaagcaatgatgtaacacgatttgagcagtaacaaatgacggtttgactgactggtagcgtaatggccagtcagtcattggtatatgggggaataattatggatgacgcacgtatggaagtcgtaatgggcttgatcatgcacggcggaaacgctaagggacaagcataccaagcaattcaatttgcgaaggaacacaagtacgacgaagcggaagaagctttgaaggcagctaacgaagaattgaaggctgcccacgacgttcaaactgacatgttgactaaggaagcacaaggggagcacaccgaagttgacttgtacatggttcacggacaagaccacttgatgaacgcgattacgttccgtgacatggccgttgagttgattgaattgatgaagcgcgtcgatgctttggagggtaagtaatggtcaaaggctataaaatgcctgatgggttcctatggggagcggcggttgcggctcaccaacttgaaggtgcctgggacgtagatgataaaggggtatcaatcgccgatgtcatgctggctggtaagcacggtgtggcacgtgaggtgacggatgaagtattgccagatggtaactatccaaaccaccgcggcattgatttttatcacacttacccagaagactttaagttgatgaaggaacttggtcttaaggcattccgtacttcaattgcttggacacgtatctatccaaatggtgatgatgtgttgcctagtgaagaaggattgcgttattacgacaagatgattgatgcgatgatcgaaaatgacatcgtgcctgtcttgacgttgagtcactttgaaatgccacttcacttggtaacagagtacggtgggttccgtaatcgccaagtaatcgacttcttcgtgaagtttgcggacacggttattcgtcgttacggcgaccgtgttaagtattggatgacgtttaacgaaattaacaaccaaacatcatggatggatccacacccaatgttgcaaaactcagggttgaaggattacagcgaagatgaggcgcaagagttgatgtatcaagcatcacactacgaattgttggcatcagctttggtaacgaagcgcgcccacgaaatcgcccgtgaaaagggttgcgagttgttggttggggacatgattgccatgaacccagtttatccagcgtcatcaaagccggaagatattttgatggctgagcgtgccatgcaaacccgttatttctggggtgatgttcacgccaacggaaagtatccaaactggttgaagaagttctgggcacacaagggcttcaagattgatatcacgccggaagatgaaaagattttggcggagaatacagtcgactatgtcgcattctcatactacatgtcatggacggtttcagataccggtgatgagtggttggaatacgatgaagaagcgaaccacggtgacaacccattcttgcaaaagtcagattggggttggcaaatcgatccagttggtgtccgttgggccatgaactggatgtgggatcgttggcaaaagccattgtttatcgttgaaaacggctttggtgcctatgacaagttggaagaaaatggcgaagtccatgatgactaccgtattgcatacttccaaggtcacattgaatcaatggaacgcgccgttgtcttagacggtattccgttgattggatacttgccatggtcaggtattgatattgtgtcagcctcaacgggtgaaatgttgaagcgttatggcttcatctacgttgatttggatgacatgggtcaaggatcaggtaagcgttaccgcaaggattcattcaagtggtatcaacaagtaattgcctcaaacggagaggatttggggtaattctaaaagaggattggtgttaactatcggttttaaaaatttaactatattattcatagaatgaggataacaacatgaatacatttattaatgaaaagttgttgccgccggtaatgaagttcgttaacacgaaggcggttacagcgattaagaatggtatgctttacccaattccattcatcgttattggagctattttcttgattttgggacaattcccatatcaaccaatcgcagattacttggataagattggtctaggacctatcttcttgcaagcaaacaacgcatcatttggaatcatggctttgtttgccgtatttggaatcgcctactcatgggtacgtgatgaaggatacgaaggtgtgtcagccggtttgttggccgttgttgtcgacatcttgttgcaaccagacacaattaagtcagtaacgaacattgctgacccagacaagacgtcaactgcttggcaagtgtcaggtgttatcgacaaggcctggcttggtggtaaggggatgatcgttgccatcatcgttggtttgcttgttggttggggttactcatggtttatgaagaagggcttcactatcaagttgcctgaacaagtgccagcaaacgttgcagcatcatttacggctttgttgccaggtgctgctatcgtaacaattgcaactgctgtttacggaatcttcaagttgggattcaacactactttggtagagtggatttacacgacgattcaaacgcctttacaacacgcaactgacggacctttgggtgtcgtagttgttgccttcttgccagtgttcttgtggttcttcggtgtccacggtgcaaccatcgttggtggtatcatgacgccattgctattggctaacaacgccgacaacttggctttgtacaaggctggaaagttgacgttggagaacggtggtcacatcgttacgcaagccttcatggaccaatttatcacggtaactggttcaggtatgacgattggtttggttgtgttcatgttggtacgcgccaagtcagttcaaatgaagacgttgggtaagttggaaatcgttcctgctttgttcaacatcaacgagccaattttgttcggtttgccattggttttgaacccattgctagccgtaccatttatcttgacgccgcttatctcaggattcgctacttactttgcaatttacttcggtatcatcccaccatttaacggaatgtatgttccttggacgacgccagccattatctctggtttgatcgttggtggatggcaaggtgctttgtggcaagctttgatgcttgtgatgactggatttacttacttgccattcgctcgtaagtacgacaaggtcttgcttgctgaagagcaaggtgatgctgagccatcagctgaagacattgaaaagttggaagaagcaactaactaatcaagttgattaagaattaagacttataggtcagatgacttataagtctttttcttttgcaaaattaaattggaaaatccgggatgccacaactctttattatcaggaggggtgtacatgtttatagcgaagaaaaaagaatcggtggatttagtgaaagctgacgtagcggtaaagacgacggtttatgtttgtcctggttgtgaaggtgaggttcaggtaaagcagggaacaattaatacaccccatttttcacacgtgacgttgcgggattgccaatccctggctgagggtgaatcgagtgatcatttattgggaaaactacaactagctgatttttttgaaagtatcggtggcactgttgaactagaagtttggctaccggaaatcaagcagcgaccagacttggtggtgacgtttgacaatgtgaaaattgcggttgaatttcaatgtgcaccaataacagcccagcgcgtatcagaacgaacgcgtgggtttgagtcgttggggatggatgtcgtttgggtgctaggtcccacttatcaacagaaaaagttgcaacaagccacttgggcgaagttcgcacggattcgtggtggacggttacaagtggcgttttggcatgctaaagggaaccgggttgaatggcgggaatggtggcgccttgattgtcgcaatcgcgtaaacgcgcatgatgcgggcgatgcgcatcgacagctattgaaattacaacaattggtgacgcaacgctcggaggtgagtcgtcggtggcagaaacgcttgtatcggttaggcagaagtttggtcggcatgccttgggtttgccatcgacttaaggcaatgccaggcggtgcccgcacagcgcaatgggagttatcattggcggttttgctggcactagaggatgggccacagactaagacgcgattgcatgaggtgttatccaagcaagtctggtttgaatttggtgcgacgcaacaagatgatgcgattgtgctgtggctggatcgattgttggcggaatggggcgcgacaaacgtgattatgcaacgtgatgacatggtttggctgaagcgagtaacagaatggtacccggattatcagcataaattggccgtgttagattagcatctccgttaccacgtgcaacttcggaacccaaagtgtagaataacaactataataaacttgaaatgaggttagctattatggcaaaagaattaccattgcgcgaagagttgcctgagtcaatgacttgggatctatcaaccatctttgcctctgacgaagcgtgggaagatgccttcgcggatttggaagaccgtcttgaatcagctgagttctttgcagcaagtgtgacgaattctgcaacggatttgtacaacgctttgcaatacggcctaggcttgatgcaagatttggaaaagttgtatgtatatgcctcaatgaagtctgatcaagacacggctaacacttactaccaaggtttgaacaacatggccgagtctttggctgctcgtgtgtcagctgcgattgccttctttgacccagccgttttgagcttgtcagaagaagagttgttagaattctttgcagctgagcctaagctacaagactacaagcactactttgatagcattttgacgcaacaaggtcacgtcttgccaactgagcaagagtcacttttggcagccgcgggtgatgtctttggggcatcacaacgtacatttggtgtgttggacaacgctgatatttcatttgaagccgttgaaaatgaaaacggtgaaatggaaacgttgtctaatggtgtttactcacgtttgttggagtcaacgaatcctgaaatccgcaagaatgctttccaaacgttctacaagtcatacatggctttggagaacacgtttgcctcattgattggtaaccatgttaagggacaaaactttatggcggctgcgcaccactacgacaatgcgcgtgaagctgcgttggctggtaaccacgtgcctgaagttgtttacgatacgttggttgcggaagtgaacaaggcattgccattgctccaccgttatgttggtttgcgtaagaagttgttaggcttggatgagttgcactcatacgatctttacacgccaattttgggtgaaccagattatgatatcgattatgaatcagccaaggctgaagcattgcaggcgttggcacctttgggggatgattatcttgatatcgtgaacaaggcctttgatagtcgttggattgatgtcattgaaaacaagggtaagcgttcaggtgcttattcaggtggatcatatgacacaaacccattcattttgttgaactgggtggataacttgaataacttgagcacgctggttcacgaaatgggtcactcagtgcactcatattacacgcgtcaaaaccaaccatatcactatggtgactacccaattttcttggctgagattgcctcaacgacgaacgagaacttgttgacggattacttgttgaagacggttgatgacaagaagctccgtgcttatatcttgaaccaatacttggatggcgttaagggcacggtcttccgtcaaacgcaatttgctgaatttgagcaatggatgcacgtaacggaagctgagggtacgcctttgacggctgacgttttggatgaagcgtatggtgagatgaaccgtcgttactatggtccagaattgacgtttgatgaagaaatcgcgcacgaatgggagcgtattccacacttctactacaacttctacgtcttccaatatgcaacaggctttgcagctgcaaccgcaatggcagacaagattttgactgaaggtgagccggccgtggcagcttacaaggaatacttgcaagctggttcatcagcattcccaattgatgtgatgaagaaggctggtttggatatgaccaagccagactacctacaagacacattcaaggtcttcgaggaacgtttgaacgagttcgaagcacttgttaacgaattggcctaaagtaaattgctataaaaaagacgctgacttcaaattctgaagtcagcgtcttttaatttactgttcttacttaaacaatgtccaccacaaagttgaggcgacgataccaccggcgataggtgccaaaacggcaacccatgcgtacccccagtgtgatgatcccttaaacttcaatggcaacaaggcgtggaccaaacgtggaccgaagtcacgcgcagggttcaaaccaggaccggttgcaccacccaatgatgtaaccaacgttgcaacaaggacacccaatgccaaaccggcaatacccttgtattcagctgatgacgtaattcccaaagcggcgaagaccaaaacaaatgttccaacaaattcgttgatgaaaccgttgaagcgtgagttagcagcgtcagtcgttgagaatggggcgaagaccgcatcaacgtttgtcgtcaaatcaaagtatggcttgtaggcagcgacaaccaaaagttgaccgaacatagcacccaaaatttgagcgatgatgtaaggcaaaacctctgaccatgggaagtcaccaacaacggccaaggccaacgtaaaggcagggttgatttgagctgagaaagctccgaaagccatagctgggatagcaacaccggctccgtaaccaacggcgatgttcaaccaaccagtttcagctccctttgtgttcttcaactcggtattggcaactgatccattacccaacaaaaccaagaacgctgttccgaaaaactcggcgaacaaacgtacgactaatgagtggtccataattcctccaaatgtgaaaataatttttaactgtttaaccagaacaaatgtttgcacatttctgtgcacaaacgaacgcttatcaatttatcaaaaaaatgcgttcagttcaatgttgtttgcgtgtttttaacccgtttgtaacgtttttatgccgtttacgacagagtctatgaacaaaatatgaaacattttgatgagaagcgtaattcatacataatacagccgtatatcattaaaatcactttcattgaaaggaagcgcttaaacagttagaataagacctataaaggaacttggaggaataactatgacagcaggtcaaatcgcgttgattatcattgcggtggcggtattgttgttggtcttgtttattgggctatttttggttcgattgacacgaactttgggggtcattacgcgtgatgtggacatcattgcacgtgaggcaaacgatattttagctaacgcaaatacattgttgaacgatgttaatggcaaggtagcgacaattgatccagctttccaagcggtggcagatttggggacatctgtgtctgagttgaacgcggcaacgcacaacttgacggggaaggttaagtcaacggctgcttcacgtggggctggtgttgcatcagcgttctcagcggttaatggattccgcaaggcgcgcaaagcacaatcatcaacgacaaagtaatcggatataaaccaggagggtattaaccatgtctaagggaaaaggatttttggcaggattgttgtttagtggtgtagcagctgcggctggatacgcctacttcaagagcttgtcaccagcagaacaagaaaagttgaaggctaaggttgacgacatcgttgttgatgttcgcgacaaggcagttgattacacatatgcagcaacggatgcggtggcatctgttcgtgatcgcgcagacgatttcgtagccgaaaagggcttggacggtaaggtcgctgacttgaaggcgcaagctgatgagaagacggctggcttgcgtgcgaaggccgatgaacttaaggctcaagccgacgaaaagacggcaggattgcgtgctaaggctgattatttgaaggcccaagcacaagacttggctgaccaagcaaagtcaaaggcaagcgaagtgaaggatcaagttcgtgccaaggttgcacctgaacttgaggatgaagacattgatatcgttttggatccaacagcaccttcattgtcagaagcatttgaagacttggaagaaccagttgcggttgaagaagcaaagcaagtaacggctgaagttttggaacccgagggtggtttgtctgagacgaacaagaagggcttgtcagaagaagcttaataatatgtaaaaagaggaacgaccgttaagtcgttcctcttttttgtagtcattattgcttcgttgaatcgcgatcaacgtaaccgtgtggcaagatgatgttcttaacagccaattcttcgcggttcatcaacttcgtcaacatacgcatagcaacggcaccaaggtcgtagatgggttgcgtaattgaagacatttgtggacgcgtcataacagccaactttgagttgttgttagtaatcaattcaaagtcttcaggcatcttaacgccagcatcagtcatggcgttcaacaaaccagcagccatttcgtcgttaacaacaacggcggctgtcgccttagcgttacggaccatttcagccatttggtaacctgattgatagtcgtaatcaccttgaataacaagtgattcgtcgtaatcgacaccagcaaccgccaaagcgttcatataacccttaagcttgtactcgcggttgatgccgtgatccaagcttcccgtcacaaaggcgacacgcttgtggccgttcttcaacaacttggtcgttgcttcaccgatggcacttgtgtagtcaatgtttacagaaggttggtcagtaacgtcatcaactgagcctgccaaaacgataggcacatcggccttagcaaattccttgcgaatatcatcatcaatcaagttacccatgaagatgataccgtcaacttgcttgctcaataggttttccaaaacttgcaattccttggtatcagattcatctgagttagccaagataatttggtagtggtacatagcagcaacgtcatcgattccacgagccaattcggcaaagtagtggtctgtgacgtcgggaatcacgacaccaattgtggtcgtacgacgtgatgccaaaccgcgggcaacggcgtttggacggtaaccaagtcgttcgataacggcttcaaccttttctttcgtttcttgcttaacgttggcattgccattgacaacacgtgaaacggtcgccattgagactttcgcttcgcgggccacgtcataaatcgtgatggtctgcttttccatgctgatgctcctttataaatctctcatacagaatttttgtcgttttcataacttttcagtcattaaccaagttgcatatctgcaaacggttacaaggttattgtatcatgctttcataaaatgttttcatgagaacattcaatatatcacaagttaatagtttagcataaataatcggtgtattgcgtcattttctgaaaatgagtgtacaatgatagaaaagtgaaacaagaggggatttcagatgactgaacaacttacaaaaatccaatcatggttgaacgacaatgaattggatgtcgcctacttctcagattttcattcaattgcctatttgacgggctttgaatctgacccaatcgaacgtgttttggcgttggttgtctttccacaagacgagccatttatttttgcgccagcactagaagtcgaggcagtaaagggcgccggttggacgcaccctgtttatggttaccaagaccacgagcaaccttatcaaatgattgccaactacatcaagcaacacacgacgcatgcaacgaagtgggccgttgaaaaggcgcagatgacgttggaccgtgctgctttgctagaaacggctgtaccagaagctaagtttgtggctgatttgtcaccattgatgactgaaatgcacttgatcaagaccccagatgaaattgctaagatgcacaaggctggtgatgatgcggatcgtgcattcgaatttgcctttgcggctttgcaagaaggtgtgtcagagcttcaagtgatggccaagttggaatacgacttgaagtcaatgggtgttgtggggatgtcatttgagacgttggttcaattcggtgcgcacgcagctgaaccacacggtgacacaggttcgactttgttgaaggctggcgatttggcgttgttcgacttgggaacgatttacgacggttacgtttcagacgccacccgtacagttgcctacaagtcagtttcagatcaccaacgcgatgtttacaacgttgtcttggaagcacaattggctgcccaatcacaagcaaagcctggtatgacggccggcgagttggatgcgattgcgcgtgatattattacaaaggctggctacggcgagtacttcgtgcaccgtcttggtcacggtatcggctcatcagtccacgaatcaattcaaattgccactggtaatgatttgattttgcaaccaggtatggcgttctcaattgagccaggtatttacattcctgatgacttgggtattcgtattgaagactcagttgtcatgacggagaccggtgctgattcattcacgcactcatcaaaggaattgcgtattatcgattaaacaaaataggatggtaccttgattttttcaagataccatcctattttttagtgccagttattaatgattgcttcggcgttttcttcagtatcggcaacttcagaacgtgtcttttcagacttcaataaaggtagcaaagcttcttggcgagcactgtgcttaatcacccaaactaagaaaaggggttgttcgaatagccaaacgatgtgacgagctgagtaagtggtcgtttgaccagttacggggtttggcttaaccggtgcggctagttctggcgtgacagctgccaaagcatcagcttcagtatcaaatgtttcctcaatcttcttgcggagatccttcttgaatgcgtcgtacttcacgcggttcttttgcttgtttgggtaatcaacaccccacaactttacgatgtcgaggatgcctgtcaaattatacgtggccatgtgtttgctcactctctattaattagtaacctaagcataccacattaggcagcgtctagtttgataatcatcttatgaatcttgtgaccggtagtggccaattcgatggttgcatcgacgttgccgtcggatgcaaaactgtcggaaaaatcaccgtggaaggtgacgtgagctaggacttcgtcgtttaaaggttcgacggagtgaatactcgtttggacgttatgcgcaaagaagtattgcttaaaatagctttgaatgtcaggcaacccgacactgatttgctttgaagcaacatcagagacaacggcgtctggcgcaaatagggagacatagctcccgtccaaatcattcagataacttatgacttggtacataggtgtagatgctgacatgaaggtgcctctttctaattagactgtaaattcattatctgcttataaaatgtgggcgtcaaacggaatgaccactaaaatttgccacttcctaaaaataagcgtaaagtagataagtcgtctttctaaggcgacgctttttgttaatcacaacaaaaagggcacttatttgtttaattttgaaagtagaggtttttatgaattccggaaaaaccaagatctttaaccagtcatttcttgaaattgcgctgattaacttcctagttttgatgacgttttacagtttgattgttgccgtcggaccatatgcggtagatgttcttcatctatcaacagcaagcagtgggttgctagttggtatcgtggttattggctcacttgtcatgcgtatgatgtccggtgcggtgctagcacgcttttcaaccaagacgatgatgatggttggtgcctttgtattgattcctagtatgctggcttatcatgttgcaacgtcaatgatttcattattggtactacgttttgtccaaggaatgatgattggactaatcgggacggttacaaatacggcagtcgtgtttgttgtaccggaagagcgtcgcagtgaaggaatttcatatttctcattgagtacagttatcgccactgcaatgggtccattcttaggtctggccttgagtaagattggctatggcttcttgtttaatattgaaaccgtgattgctgtgttggcatttttagcaaccattttgattcacaaggaagccgttgatattaaggcacatacagttaaaaaggttgaaacggctgataagcgaactggtcttaagaagtttttggagcctaaggcagtgccgttggcaattgcactgtttattgccacgttgacgtattcagccatccaaagttacttgagcttctttatgaaggcgcaacacatggcctcagtgaccgagtacttcttcttgatttatgcggcagtaatcttcattagtcgcccatttacgggtcgtttggctgatgaaaagaacgaaaactacatcatttacccaggtttgattttgcttgccattgggtttgtgttattgagccatgtcacaaacgtttgggtattcgtattagctgcgattttcatcggtgttgggttcgggaacttccaatctgctgcccaagcaacgattgcaaaaattgtgccacctgagcgcatgtcatatgccacatcaacgtacttcatcttctttgatttggcatttggtgtcggaccatacttgcttggtttgattgaaccaagtattggcttcgtaggcttgtacgagttgatgattgcgtttgcgattattgccttggtttgttacttcttggtacacgggcgccacgttaaacgataaatactattaaaacattagcgaaaactcggaaaatctgctacattagatacagataagattcgagtttataacgacaaaaaagacgaccaccacagatcacttccggtctgtggtggtcgtctttttgtatactttcgactattccgtgaattgtgtgaacgttttataaatttaagggttgtcacgtgaaatacagagcaaatggcattattctattgttacaaattagttacggatacttttagaagaggtggggacaatggaaaaagtgactaggttatttagaggggcaatgttagcgactgtaatcgtaccctttgccggtctacttacattaccgacagcacaaagcgtttcggcggcagattatggggtgaaaatctctaacggaacgcaggtgctatcaaacattgatggcacggtgacctttgcagggggaactgttaagcaaacgaaaacagccgatggccaggtgaatttgtatttggctggtgtaacgttgaatccaaatggcgatggggcgtcaattgtttcaactggcaatcaacaaacgcacctttacttccaaggtgaaaagccttcagtggtaaagggtgcgttgcaaggaatcacgacggtaactggggctgccagtttgttgggtgggtctcttgacgcattggctgtctacgcagaggacacgccaggcatggctagcgagatgcaacttgaaggggattttgctaagccagtgaccttgacgcataaggatggtagcaaggctgtgccaactatcacgcttggaaaagatgatgcgacccgtttgaatcgattgattttggcaggcaagtcgacggatagcgttgttggtggggatgccattatttacaacccagaacgtgttttgtcaggcgatttggacaagataattggggcgacatcatggcgtgtcgattatgatcaaaacgatacggactggagcgatgcggcaaattacagcactcgcccattgtcattgaagggaccaaatggtgagacggcaactcgtatcgaggtttcaagtgtgccgttagcgtttaaagcaaataatttggcggttgtgaatactaccaagttggcagctgagaagattaacccaaccgatttgtacaccgcaggtaatggacaaccggtgacggtatcgattagtcaaaacgggtcggattatacgacctttatggtggtgagctggcagctggtcaatatagtgtgaaggttagccaacctgcaaatgttgacaagggcgtgtttggtggcgaagcgactggtgaattgactgtccaaacaacgccggcaccagcaccaaacaatggtgggggaaccacaccaacgcctgtgccaagtacaccggtgacaccagcaactgtgacgccgacggcaacgcctgtgacgccagcagtgtcgagggcggttgtggcatcaacgccagcaacgacaactgcggccacccaaacggcaaccgcagcaccggctaagcaaacgccagccgcagctaatgcaacgttgcaccacggcgcagcgagtgatccattacatggaccacttgaagtcgatatgccggtgaagtcaaagacgacggcgaaggcaccagctaaggacgctaaacatgagaatgccttcctaaagcgtgcagccggcttgagtacccaagctgttgtggccatttggtcagtcgctgtgctggtatttgttggcttagtttaccttggtatgcgttgggcaaagcagccacaagctgctgaagtcaacgacaataatgaagagaagtaaatagatgacaaagcatgctgatgacagcatgctttttttgcccggttggttaatttaaggcaaaaatcattctaaaaatgcccacgcttaacaaccgtaaacgtccatctgacctggtattctggcactggaaagggagaatattgcaaatttgtgatgttgtcttgcttagaaagtattgtttggggaaataacaatggtaaaaacaaaggataaaaagaaaaggctggaaaacagcaagttctgggtcgcagccggactgaccgccgttgccgttggtggcgtgacgacagtcgaaccgcaattctgggactttattgatgatgaaatgcatcaaacatatgccgctacggttaactcgacaacaacgattgatcaggtcaaagatgtggataccgagaatggtcaaagtcgagatgtgaactggggagcaacaccaatctggaataacagtgaagtggacggattgggaacgtacaagccgactggcaatccttgggttgcagatagaaattataacggtggtaataaatattcgaaaaatggtgcgtattatacgaaattggtagctgatggacaaactaatgccggatatacttacttaaatcgtcagttcgatgccacgaagccctttacaatttctgggtatttgcacccaggaaaatcagatagtaacacgacgctagtaagtaattattctgattggactggattattgctgacaccaacgaaccctgatgatattgccaaaaaatatagtttagatagttatggtggaagtggtttaggaattcgcggaatggcgaaagcgtttgcgttggggattgactttaacgtaaacacatcaacgggttataacgatccgagtgcgacatcctcatttgctgcgctccgtactacggatgccagtggaaatttggttacgcctaattctaatctctataagtcaggcgtttctaattggcaaaatacaattcgctacacgttaacttggaatccaactggtgggccagacggcaagtcgccatcaatcgttgcgacgatgacgcctgatggtggttcgacttggacgatagatactaaggcgtctggtgtaacgctacaatcagtcagtgcgttgacgtttggattgaacgccattaacggaaataatgcaggtgatcaatatgcattaatggacaatgtaaccggtaccttttcaacgggaacaaccaccgttaaatatgttgatcaaaatggtaaagaaatcaaaacagcaactagcttcatcgccaacgttggtgaaacagttggaatcaccggcttgtcttctggtgttgactcagcggattatggctatgcagccccaacgattaaaggctatacggtgagtgcggcttcggctgttaagaaggtttcacaaacagcatctgataacgttatcacgattacctatgctgaaaagccaacgcaacaagctaacattcaaacaaatatgccagcactctggaatgggtcatcgacgattgcctcgtacacaacgaagcaacaagatatgccattgggaaattctagtagcttggcagctagcatttcggatgcaagtttggtgcggtcaggatatagctactatgtgacggggccgaatggcgcgagttatgcaacgatggcgtcagcttcagcggcaactactaacgtttgggacagtactgcgaacgccgttggatcagcggatagtactccgcaaacatggacggtcaactacgtggcaaacccacagcaagccaatttgtatgtgcaatattttgcaccatcaggcggtagttgggtttcttcaggaagcagttcattatatgcgtcagccgttggttctacaggtggtagcatttcgtttaccgcaactgactcacagattacagcggcttctgggtatcgttatgtcatctatggaccggataataagtcctatacaacgttgagcgcagcccagtcagcgtacagttttgatagtacgaataacacgacaacggatgcgtcagcacaaaacttttggttgtactactatccagcgatgcaatttactagtttggtggttgatgcaaattcgccggtaaatgccgcatccgtgttagcttcctcatatggatacaccaatacggcgttggcattgccatacactgatacttcgttgtccgctcaaggttactcgtatgttgtgaagggaccaaatggttcagagtacagtaatttgtcagcagcaatgtcagccaatgcaatgtatgatgcgacaactaatacatcaaacacggatagttcggcacaagtgttcacagtaagctatgtgccacagtatcaagcggcgcaaattcaatatgccgctaatgggccagtcagtgccggggctgttttggcctcgacagctggtacgacaaataatgcgattagttttgcaacgtcagatggtgatttggcgcgcgttggttacacatacacggtgacttatccgggtgatagtgtttcatacgcgaccttgtcagctgctttggctgcgcacggcaagtacgacaacacatcaaacgctggcacgtcagatgctagtggtcaggtgttcacggtcaactataagacgaaccaatatgctgttttgcagacaacgccaactgatacgtcgagccattcggtcttgagttattcagcggtcagtgaatcagcgaatgggccagcaagcagtgccatctcatttagtacaactgattcacagttggcccgcagcggttacacgtattcagtggttgttaaaacaattgattcagcgggatcaattctgggaagtgtgctggcttcatatacgacgttggcttcagcattggctgcgcaaaagtatgacaataacttaaacgacacgaacgcaacagttgatgcacaacgtcaattgtttgaggttgtttattcgccagaatcggcaaccgtgacatatcactatgttgatgaaaatgggacaaaacttatcgaaccagtcaactcatcaggtgtggttggggcgaagattgatgatcgttcgatggtcatccccggttacaccctaaccggaccggatacagctcagtcggacacagacggcatatacgatgctgacaaagtttcaacggttacctacgtttatcgtgcaaaccaccaagaagccacattggcggtggatagtgcatccccaaccgctgcaaactcagcaattacatcagcaagtggtgtaacaagtggcagcatatcgtttaacgtaacggacgcgcaactggcaaaaacagggtacacctacacgattatcggaccaactggtagttcttatgctaatttgacggctgctttggcctctaatgccttgtatgacaacacgacaaacggatccgctacgactgattcatcagcccaatccttccgcgtactttataaggcgaatgtgcaatcagcccaaattacggtccaagaaggctcaccaattagtggcggtgcttcactggatgccattactggtgtcacgagtggtgcgatgtctttcaaggtgaacgatacgacgttgccagtatctggatacacatatcgcgtcggagttggctatgatacgtcaaatatcacgtggtacgcgacgctgtcagaggctctatctgcaaatgcaatctttgacaacactggtacaacggatacgaaggcacagttcttctacgtttcatatgtaccgatgagtcaggccgcgacagtcgccgtgacgagtgactcaccaatcagtgcaggttcaacggtgctttcagccgctggatcgactgggtcagcgatttcgtttgcatcaaatgtgtcttatgcgacgttggattcacaattggctaagtcggggtacacctacacggtcaagtacggcagtgatgcaacggcgtacacaacgttgtcatcagcgttggcggctcacaataagtacaacagcaataacacaacatcaggcacaagcgatgctaatccagatgtctttaccgtgagttacaaggcggactcacaaaccgctattttggctgtgacgagcaattcgccagtggcgtcaggctcgattgctgattcagcttcaggtgttacgtcaggtagtttggcgttcacgatgaccgattcaggcctggccaagcgtgggtacacgtacacggtaaccggaccggatggtagtgtttacagtaatttgagcgccgctgtggcagctaatttgttatttgataacacgaataatccagtttctggatcaagtgacacggctattcaaagcttcttggtgtcatataaggctgattatcagacagctgaagttgtacttggcgagtcaggaccatacgcctcagattcagtctttgcgacgacttccggggtcacatcgggttcactttcgttcagtatcactgacgccgatttggcgctgtcaggttatcactatgtggtttggggtaagtatgcgacgagttcatacgcaaccctaagttcagccctcgcagctgaaagccactttgacaatactccgaatgggtcagcaacttcagatagtcgcgcgcaacaatttgtggtgatttacacagcggattcacaaacagcaaatatcgttgttgacacaacctcaccaattagcgctgggcaaaccgtgacgtcagcggccggtgccactagtgaagcaattgcgtttgcggatacggctgacagtgatttgtacgtgcaaggttaccactacacggtgacgggaccagatggttcggtttacagtgatttggcaacggcgattgccgcaaatagcttgtatgacaacacgactaacacaggcacaactgatgcgagcgcacaaaacttcacggtgacttacacggccgacacccaatgggcatcattggccgtgacggatgattcaccaatcaacgccggctctgtgattggctcattgtccggtaagactgctacgaacatcccgtttgatgggtcagatgcagcgttagttgtgtcaggttacacctaccaggttcaaggaccaaacagtgagtggtatgacacgctagctgaagcacaaagtgacaatacgacgtttgataacacgagcaatgccggtgattcggatgctgagacacaaatgttcttggttagttacacggcaatgagtcaagctgcgacgattgttggggcagcggattcaccaattagtgcaggcatggccatcgaaagtgcagctggtgtcacgagtgagaagattagcttcacacacaacgacagttccttgagtcgcagtggctacagctatgtggtctacatgggttctgacagtgggacgacatacagtacgttgtcggcggctctggcggcaaatagtttgtacaacaacacgaatacgacggattctgatgccgatccgcaagtgtttacggtctcttatgtggctaactatcaatcagccaacttggtgattggtggcgacacgcaaattagcagtggcgtgacacttgattcagctgccggtgtgacgagtggccgtgtgtcattcgccacgacagattcagcattggcattgagtggttatacgtacacgatccagacaccaaatggcactgtctttgacacgttgtcagcggctgtcgcaggatcacaaggcttgtatgacaatacaacgaatgctgggacttcggatgccacgccgcagacctttacggtggtgtatgcagcaattacacaaacggctgaagtggttgttggtgaaaccagcgatatttactcaggtcaggtgttggctaaggtcactggtgatactggcgcgactttgggactaacgttgactgatgccgacttggctaacatggagatgacgcatggttatacctacacagtaactgttcaaaatgcggatggcacgatggttgttgatgcggatggtaatccagtgcactacgcaacgttggcagatgcggtggctacaaatgatttctttgatgcggtaaatactggtatcaagaagtttatcttgaaccccgtcgcatcatatcaagagagtacattgacggtgacgagtgaatcgccaatttcagcaggagtggccgttgaaacggctagtggtgtgactgatggtcagctgagttttgcaatgacggatgcaagtctggcgctttcagggtacacgtacaccgtgacagtcgtgaatgcggacggcacgcgcgatacgtacaatacgttgtcagcggcggtttcggccgtttcaagttacgacagtacaattaacggtagtgggtcaactgattcaagtgcccaagcctttgaagtcagctacaaggccgattaccaatcagctaatgtgaactttgcgacggctgacggtgataagccgatgccatcaattgtaaccgcgggtgttacgagtggcgcttacacgtcaacttacacagcggctgatgggtattacttcgttgcttcaggtcaaccaagtggcgtcagtgtggccgcagatggtcgcacggcgacgttgacgtttaactatgacaatacgaccaatttaagtgcgacggatagctcggcacaaacctttaatgtattgatggctggggcaagtcaatctggtgagattagttactcatattcaaacgcagttggttcgccaacagtgccagatgccgtcccaatcgccggggtgacaggtgatacaaagtccggcacgattacagcgccagacggttactacattgtctcagtgacgggtgatcaatattcagtggtttacacagatgaaacccatcaagaggcaacgtactcagttattttggatgacactaacaacggtaatgagacatctgatactacgccacaaaacttgctggtcgtcttggcaccaaacaatcaaactgcaacgttgactgaggtaatgccaacgggctcaagcagtgtggttgatacccaaaatgaccggacggccgattcttacagttacacctatacagcaccggcaggatattacattgccagtgatggtgtgacacctgcttcgggcgtgacggcgtcaattagtgcggacggcacgacggtaacgttgaccggtacttacgataattcaaaggatttggatgaagctggtaccgatagtgccgtccaaaataccgctattaccttgacccaagcaacccaattagccgagtttaaggtggtcgtaccatcgtgggcgaagaccgtttcggccaagctgaacacgattgaaggtaaaaccggcgaggcgattatcgcaccgactggctatacggatgcggaattagctaaggatggttatacgtactcagtcaagggaccagatgggacgatttacgacacaatggctgaagcgttggccgccaatgcaactttcgatgatagtaacaatggatcaggtagcgatgttgagacccaaacctttgaagtcacatacacggctcagaatcaaacggttaaaattttgcaacagtacgccgatggaacgacgaatgggccagcgtacccacaatctgatccaacgttgaatggtaaaactgatcaacaagttgctggcacgattacggcgccaactggttatgaaatcgtggatatcactcaagttgatggcgtaacgtgggaaattgcggctgataatctatcagcaacctacacaattacgtatgacacgattactgaagaagcgccagcgactcgggcaatgctccgggcggcaaccgatggcacggtgagtcaagaatcagtggtgacgtacggtccgttggatcaaacagtcaatgtgacttttaaggatgaagttggacgtatattgacgtctgatactggcaagaacggacacgcgctagaaggtaagaccaacgaagcggttgattatgatgacgcatcgttggcagccgacaaggttatcgatggctataccattacatctgacacgacggatacggcaactaattatgatgacgatacatcggttgctcaggatgtcaccttcgtttaccgtgatacgcaagcgccaactgtgacgacgactaagacagaactggtttcctcaaaggatggtttgccagctgatgaagcggccttcttgtcagcagttggttatgcgacaacggataaccaacaatacggtgactcaacggtttcaaccgattacgacagtgtgatgaacgatgtgaaagctgacggcaaggctcgtgaagtgacgattacggttaaggatgcaacgggtaataccaccactaagacagtgatgttgacggtggttgatacggcgccagtctcacaagaagctgatgttcaaacggcacagaagaacttggatgatttggtgagtgatccgaatgcgagtgatgcagacgttgcaacagctaaggaagcgcttgaacaggctatccaggatgcgcaaacgcaacgtgatgaggcgaaggatgctgcccaggcggcatcaacgtcagatgaaacccaagccgtagctgatgatccaggtgttgttgaggcacaacaagctttgcaagatgctattgataatgccgatgctgatactggcacaacccaagcgattactgatgccacggctgcccttgaaaatgcagtcgcccgtgcggaagctggttccgttgatacggcaccggtttcacaagaagaggctgttatgcaagcgcaatctgatttggatgatgtgttggataatcccgacgcaacaacggccgaggtggatgcagccaagcaagctcttgaagacgccgttgcacaagccaagtctgaccgtgcggatgcgaatacgacagccgatgataccaagacacaagtgactgatagtcaagacgatgcggttaaacaagccgtggctgatttaacggctgtgcaggatgcggccgcaaatgacgacgcaacaacggctgatattgaacaagcagttcaaaaggtcgttgatgccgtgaaggatgcagcccaaaccgcactagatcaagatgcgtctccggttcaaaatgaatcaaccgttagtcgtgccaaggataatttgcaagatgttttggataatgcagaaagcacaccacaagaaattgttgatgcgacaaacgcttataacgaggcagtcgctgatgcaaaaactgcgcgtgatgacgccaccaaggcagctgaagatcaaattacaacgacgaataattcaaatcaagtgaacgatgcgtcggtaattgatgcgaagaataagttgcaagatttgttggataaggcagccactggggatgctgatgctttgacggctgatattgaacaagcgacgcaagatttggctgatgcggtggcagcggctggtggtgcgcaagatgcggcacgtacagcggctgatgaagcgttgaccaagacggcgccagtgacttacgagccaaatgtgcaagagaagattgacgccctgaatgatttgttggctaatgaaacagcaacggctgatcaaattaatgacgcaaccgcagcattgacgtcggctgttaacactgcaaccacgcagcgtacatcagctaacgatgatgcagcgaccgccatttcacaggcacagagttcaaatcaatctgaagagccaactgttcaagcagccgaaaaggcgctgcaagacctagttgaccaggcgaagaccaacacggaagacgcgttgacggctgatattcgtgatgcgattaagaatttgcaggatgctatcagtcaggcggcatctgatcaggatgaggcacgtgatgctgcccaagatgcgattacagctgcatcgccggtatcaaatgaagcggcaacaaaggcagctttggacaatttgcaaactgttttggcaaatgagaatgcaacgaccgctgaaattcaggaggcaacgcaagcagtaacggctgcgtctaagactgataaggccgaccgtgatgccatgaacacaaaggccaatgatgctgtgacagctgcgcaaacgggaaaccaagcgactgaaccaggtgtcattgatgcgattaagaatttgcaagatttgcagactaaggcggcaactgatgatgccgatgccttgacggccgatatcgaccaagcgattgctgatttggcgactgcgcaagaaacagcggcgggtaaccaagaaacggcacgtgatgcggctaaggcagcgattgctgagactgagccggtatcatatgaagatactgtttccacggcgcgcaaggcgttagataagttgttggctgatccggcggcttcaacccaagacattcagaatgcaaccaaggctttgactgaggcaacggcggctgagaaggataagcgtgatgcgattaacaccgaagctgacagctatatcacggatgtgcaaaattcggtacaagctagtgaaccaacggttgtgagtgctttgaatgcattgcaagaaatgcaggcagaagcagcgaccgattcatcggctgcgttgacggccgatatcgccgagaagttggcagaattgaaaacagccgttaatcaggcagcaacggctcaagaggcggccaaagataaggcaaacgaagcgcttaatgatttgcaaccagtatccaatgaaccaggtgttgaaacagcgaaggctgcgcttgaaaaggtgttagcaaacgacaccgcaacagctcaggagattacggacgcgacgcaaaagttgttgaatgagacggcggatgcgaaggctgaccgttcatctgctgaaacggatgcgcaaaatacaatcaccaaggcgatgaacagtgaacaaggtggagagccggctgtgcaggaagcaattgatcatttgaaccaagtgatgtcagatgcagctaatgattcaccggatgcgctaacagccgatatcgatgctgctcgtaaggcgcttgataatgccttggcaacggctcaagctgctcaagagcaagctcgcaaggatgcagcatctgcaattgcgcaagctagtccggtttcacacgagttggccactgcacagacgattaatgcattaaatgcagtgctcgcaaatcctgatgcaacagcatcggaaattgcaacagctaccgcagcgcttaatacggcggcgacagctgataagggtgaccgtgatgctgcgaatgcagccggaacacaagcgattgctgatgcccagggctctgatcaagtgaacgaaccagcggtgaagtcagcattgcaagagttgcaattagtgatgtcaacggcagcaaccgatacggcagatgccttatcacaagatattttggatgctatccaaacattggctgatgcgcgtgatgcggcggctgcaaagcaagacactgcccgtcaagacgctactgatgcgttagtacaaacggcgccgctttcaaatgaaaagccggtggctgatgcagtgcgtgagttgaagaatttgttggctaacccaacatcaacggcagctcagattgcggatgccacccaagcagttcgcaatgcggtgagccaggcgcaaccagaccgtgatgctgcgaacacggcagctgatgatgcgattgcgcaagtaccaagcgatttggcggatgagccgtcagttagtgctgcggttgctaatttgaaaaagattcaagaacaggctgcagctgataatccaaatagtttgacagctgatattaatgcggcaacgaaggcgttggctgatacgattaaggcagccgaggctaatcgtaatgcggctcgtgatgctgcaagcagtttgctgggcaagatggcgccattgtcgaatgaggcagcggttagtacagctaaggatgccttgcaaaagttactggatgacccaaatgccatcacaacggcgattgaaaatgcaacggctgcattgcaggctgcccttcaaaaggatggggctagtcgtcagtcaacgaacacggctgccgataagcttgtggctgaggcaaagaatccagcgattgccaataatgaagcagttgcgcaagcgatgcaacatttgcaggcagtgcaagcagcagctgcccaagacagcgcatctgatttgacggccgatattgcggctgccatgaccgcattgcaaaacgcgatgcaagatgcgaataacgctttggatgccttgcgtcaagatgcttcggatttgatttcccaagctaagccggtttcacatgaggctgatgtcgcgccaaaggtagcggctttgcaaaagttgttggatgatccatcagcaacgagggaccaaatccagcaagcgatggacgacttgcagaatgcgacggcgacggctaagactgaacgtgaagcggctaatcaatcagcccatgatgcgattgccgcggctaaccagtcggcagtatctggtgacccagccgtacaagaagcgttggcaaagttgcaagcaatcatgttggcagcgtcaaacgacagtgcaaccgacttaacggcggatattttgaaggcgatgcaggcattgcaagatgcggtacagtcagctgaaagtcgggcagcagtagtggtgcaaccgacgtcatctgtaccaccagttaatggtgtacttgcatacacagcaaatccaacaactcgtttgttggctggtagcacggtaacacgatcaggcgttttgccttacacgggttaccatgacgattggtatttgatggcactcggaatcttcatgttctcggcaaacttgttgtttgtagcaacaaagcgccgtaagaaggatgaagaagtagagtaggaaatgaaaaaagaggctttgagacgaatttgtctcaaagcctcttttgatgtgtcgcaaaataaaaaagtagtacgtttctacaacgtactacttaaagagaaggagccaacgggatttgaacccgtgcgccggctcaacaccggttcggcggatttcgagtccgctgcattaccactctgccatagctccataacaatatttaatattataaacatgattattgattgtttcaaggtgattaaatgaaacaaaaaagacacccagcaaactggatgtctaacatgatagcccatcagggagtcgaaccctggatgccggtgtgaaaaaccggagtcttaaccgcttgaccaatgggccatgaaaatgttgaatgcctaatcgacaaaggcaatagctcatcagggagtcgaaccctggatgccggtgtgaaaaaccggagtcttaaccgcttgaccaatgagccatgaaattgtttgatgattacttcgctaaaagtaatagcccatcagggagtcgaaccctggatgccggtgtgaaaaaccggagtcttaaccgcttgaccaatgggccatgaaactttgttaattgcttaccgctcttaacaacagataataatataccagatggatatttatcatgcaacacctaatttcaaaaaaagtcgacttttcttcaaaaagtgtctccccttgcactaaattcgtgtgttccgtacactaaagtcaacgattgggggcgtggggatggatgaattagcgtgggtgttagaaaagaaagaacaagacaaattaacgttgctgaactatttaacgacgcgatcagatagtttttttccaattaaacgtattttgacttcgttaggctggtcacgttatcgcacattgtcgacaattacgatgttgcttgatgatttagagacatattttccaaatgaaccaacagcgtatgcgtatgatgaaaaacaaaaagcggtcacagtaaatcgtgctgtattggtggatgtcaaaacagttgcgtttgattatcggcaaaagtcagttatctggcagttactgggcgtcatttttaccgggacatttgaatcctatgaacaatttgcagaaacgttccacaccagtgtaccgattgcgcgagctgctaaaagtaaaattgctacggtgctgaaacaagccaatataaaattgaccttgcataatggcctggttggaaacgaaacgaccattcgcatctttttctttggcttaatgcgtcaagcgtatggtaatcatgagattccatttccgcctgacatgcgcgaacgaacggaacaagccgtactagcaattgcaaatctatttaatattccattgcgcgagacgacgaagcaggcaatgcgaatgcaatttacgatttggtattaccgtctcattaatgatcatcatcttttaccggaagaaatcccggcgctattaacggattcggcgaagtgggatgctgaacatcaggcgacccgcgccggactaattgagttaatgggttcatttgtgtctttgcctaaagctgttgtggaacgtgaagctgattttgccatcgcgagtctgtactctacggggttcgcttcgagtgtaccggtttcgctgttgactgaagtggctcagaaaaaattggcccggtttaaaacgattgttaagacggagtatcaagcgctatttaaccaggaactttcggaacgcattctgaatcgtgtgacatcgcaactatcagcaaccaacatgcgtacagcgtactttagtgtttacggttaccgaccaacgcctgatttagaaatcgcgcaccgtgattttccgattcatacggcgtttgtgttgcgggtgctccatcatcttgctgagaaaatagggttcgacgagcaggtgctggttaattcattatttgaagagtacttagatgccatgattcgcaatttatcaaagcacgccatcttaccggcggttgtcgtcgtgattgatatgacaaatttgccggcacttgaagaattgattcaagaccggctgaaacgatcaccaatgattaacgtgattgtcgcacatgaatttcgtccagatactgatttttacatatcagatgttgaaatttcgcaatttggtgtaacaccaggcttcatttggacgcgctatccggacgaaacgatgtttgcacagttcattgagcaagccgtattgcttacaaaagacagatttaaaggtcagtgattattcactggcctttttagtgttttcagtaccttacaaagaaaaagtagatttttttgaaaaaaacagaaaaaaacgacgtggtgaagtttgttgccattcgataaagttaagcacgtaaacgattcctatttgttgaacgggaggagtgagatgagaattggaagactgattttcggcgttatgctgggtgtcataagtatgtggtttagtcatgatttgtacgcttctgagcatcgggtggaaacgatgcgtgaattcgagcaagcttggcatttagacgaaccggatcaaacaattcggttagaagcggatattgttgacgacattgcgacaggattagcaccacggacacaagatgtcacattgattggcgatggttatgaattagcatttgcacctgagcagaacaagcaaccggttagtctgaccagtttgggagagattaaattaacgggggaattgtggttgtcgggtgccgaagaagcacctttaattaacgcacggcgggtccagacattgcccgacagtaatgtgtccatgagtcctggttatcagggtcgcatgttagtggctgacgaagtcattatcaatggtcaattagtattgcacggatcgcacggtgacatgattaccgcaccaaatattcaggttgggccagatggttttgtcgaagcctttggtcaaactggcggtcacgtttttgcaacggataacggtgggcaattaacaattgcgccgggcggtcatgtatcgatctccgtccttcagcaaagcgatggtccaatcgtaagtccaattgacatgggctttgatcaagtcgttctgcaagatgggtcgcgagtggatattgcgagcgtccagccagccttattctggcagaacacggacgctgcaatggtgacggttgaatcaggtggccaattacaattgaccgggttgcaacaacaagccgtcgtttataaagatcaaaacggtgtgagcggtggcggattacaggtgaaacaagatggccgattattcgtccgaggtcgtaccaccactgctttgattgaattttgccagccaacggtatttaaaatcgttgcaccagctgaattggagctggtcaatacgcaggagaggggacttgtgtatcgaaaaaatcgtggcacttttgaactacaacagcttatcgcacacagcacaacgcctaattcagatactgaagaattttcaatccaatcattacgcgtgaaaggacgtggcaacggacaaaccgtgagtgatttgccatacgctgcttcaacttggttggacagcttaaataagctaacggcccgaccgctacaaattgaacggccgatgacgctggcgatgacaccagtctcatttggcagtgtgtcaaagtcatacggtcagtcaactcgaacagctgcactacctggaacaggtattttgacagtacaggggagtattttgaaatcctgggcagtgcatctacgactggcccgaccgtttaccaatcgggtaaccggacaagtcatttcaccgcaattgattgcgaatcaacaaagcataacggaatcgtttcaagagatattgagtggtcaagaggcacagacgcatgaaacgcgttttgagatgcaaatcggagaccacgaggttgtaccgctcggcgactatgaagctgagcttgagattaaattggtcgcaggaccatagagataaaatgggggaattatagatgatggtgtttaagtgccgggctaccttggcagtcttgacggttggattaacaatgctgacgggtggatcaatcttttcagctgagaaggattcaactacaaccgtgccagcgacggttagctttgcaggggttgaagacccaattgcgattgatcggttaaatccgactgatgcaaagaccaaggacccagctgcaccggcaaatatgcgtaaggcggggatgccgttgacgattgattatgcctcaccttggcgttttgacacgcaaaaagtgagtttgatggatcggacttattcggctgagcgcgatgtatttgcaggaaatccggttgctaatcacgtacaggtgactgaccaacgcgaaaagttagatggttgggaattgcaaattcgccaagcaacgccgttcaagcatgcaactggcactgaattaaaaggggctaagctacatgtgggtgaaatgtctgtgaagtcagctattgaaggtactttagtgatgccatcaaagagcgcaatcacgttaaacggtgacttcgctcgcttagctagtgctaaagctggcgatggctatggcacgtcatctttatcgatggcggatgttaagttaacggtaccgggtcaagtgaaaaaattggccggtaattattcaagtgaggtagtttataagctccttgcagcaccgacgggagcgtaaaagagatgaaattggtttggggactagttgtaatgatgttggcgatgttgttttggggaacaacatcggcaaacgaaatgccattcagcgtacgagtgatgcaagcaactgagcaacgttcggaaacgacaggatatttcgatttagttttggcgcctgatcaagtgaaggaagttcaagttttattgacgaacgacacggagaagccacttacggttgatatcaaatcagcgcaggcgacgaccaatcgtaacggcgtcgttgattatgaaacggcgcagtcaacagcttggcggaatctggtttcggtgcccaaaaacattacactaccaccgcatggtcaagaattggtcacgagtaccattcatatgccagcaaaccaatttgacgggataaaagcagggggcttaacattttctgagcgcaagtcgccaagtgattctaaggaatcgggcgtgcaaataaagcagtcgtatgcgtatacggtggcggtcttagttcgcaatcacgagggggatgtgccggctaagatgcgctctgcgggggcacaacttaaaacggttgctggtgaaaatatgctgcaaacgatgcttgtgaatacgatgcctgcatttcaacatgacattcaggtgcggacgcgcttgtatcaaggtgatcagttgatttttgacaaaatgcaagaaagtttgcggtttgcaccagatagccagtattcacatctgacaaagcttgatcagtcgttaggagccggtcggtatcgtgtggtaacggatgttaagacgaatcaaggtaagtggcattttaacgatagcttgaccgtgacagcaaagcaacgagtcagtggggcagttgcagaagcgacacggatgccaatttggttaaagattatgttgggcattattgggatattgctcatgataattgtttggctaatcattttgatgcgacgtcgtaagcaaaatagtaggtattatcggtcgggacaacgagtgtctcggccgattttttgttcacacaaatgaaatatttaccgtattctgttcagaattttcgtactgttttggcgctgttttattgcggtgacatcatattcgttttttatactggcggtatcacaagaaattagagtattagcgaggggttaataatgaaatcaaaatatgatgatgaggtgccactgtttaaagcaggcagtgaaggcactcaaaagaagtggttggttaaaggaatcgcaaccttagccatgctcgggggaattgcggcggcgagcgatgccagcggtgttgcagataaagttgatgacatgttcgaggctgctattcatatggcgttggagccggcatcggcggcaacggttgcgaacacgacaatcgataaggcgaccgcagtgcctagtcgttcaacgacgtcaactggaaaagaaaccagcgactatcttgttaagggaagtgcaagctatcaatctggcaattcgaacaataattattcgtggtacagcttgtctaatggaaagcagcaaacggggttggttgtttataatacggcgctggatacgaagaacgattttactgccagtggatcgttttatgttggtaattatgcggcgaacgcggcggattataacggtattctgctgtcatcaattttgcctgatacgcttggaagcggaaccggtggtggtggccttggaattcaaggtattaaaaacgccatttcgtttggtatggacatgtactcaaatggatctacctacaaagatgccagtggcacgtacccgatggttggtatccgtaccacggactcaagtggtaatctgacacaagcatcagtggatagttcattgacgtcaggaagtggtgtttcaagtttgccagctagtaataagcctgacggtattaacgctggaacgggtgccgcttggtcagtgaagtataccgcctcgactaaaacattgacgtttagtttgggaggtaaagttaccaagagtatgacgattaatacgacgacgatgccgtatttgtcattcgccctaattggttcggccggagataacacaactgaaatgacatcgtcaattcagtcagtatcaggaactaaggcctcaatgacggtgccagtgacgtataaagacacagctggtaatacattgttgactagtacgaggttggacgtcggtgatggacagtcagttggaatcaatggtgcttcacctaaggcatcaagcgatacatttagttatgatgcaccggttgtgcctggttactacattaaatctgcgaatgatatttcagttaaggttggttcgggaacgacaccttcattggatttggtgtacgaaaagtcaccgcaacaagctacggtcaatcgaactgggttgaatgcggcaaatgcggttaaaaacggaactaccgttgctgcgagcggtgtgacgagtggggcgattgccattgcggatgctagtttggcggttgctggctatagctatgtcgtcactgcaccggatggtaagcagtacagtacgatgagcgaagcactggcagctggttcgaatggtgtctatgacagcacaactaatagttcgggtgcttcggatgcagcggtacagagctttggtgtttcttactcagctttgtcgcaaaaggccaactttacttattcaggcggcacgccactttctggtgcaccaaccgttacttcaggtgtaacggatgatgcgttgccaggttcgttatttgtttatgcaccaagcggttatcgtttggacagtgcaagtacgacattggcgtcgggcatttcgatgacttatgctacaacgatgcgtagtgccacaatcaccggtaaattcgatgcagatacagcaactgatcagaactcaacgattgttttgaaggctgataagcaaacggcgacattgaagcaggttgtgaatgctaaaacgtcagatgtggagtcagtaacaggtggcactgatagtaaaattgcgtttacagcaactgatagtaccttggctaagacgggttatacctacaatgtcactggcgcagatggtaagacatatgacacactatcagcggctttggcagcgacaccaaattacgataatacaagtaatgatggtgacactgacgcgactgcccaagtattcacagtgaattatacggatacgcaagcgcctactatttcaacgggtaaggatagttatcaggtgacgaccggtgcgggggtgacggctgacagtttcttgacggcgattaatgcgcaagcaaccgataatcaaatggacggtagcacaacgctgacatctaattatgctgatgttgtgaaggatgaaccgggaacgtatacggtaacgttgacggcaactgatgcaactggtttgaagacgacgaaaacaattacagtcgttgtgacagaaacgtcaccatatgatcaagaatcagccgtctcatcagcagcctcaaatttggaaacgatttctaatgatccaacaaagacgacggctgatgtgcaggcggcccaaaaggcacttgatgacgcaattgcagcagctaagagtgaccgtgaaacagcgaagacaaacgcagaagctgctgagacaaacgccactgaccaaggtgtcgctgacgatagcacagttgtcgcagcccaaaaagccttggatgatgcgattgcggcagcggataataataccggaacaacgcaagcgattgtcgatgcaacaaatgcattagaccgcgcagtagcagttgcttcggcaaaggctgtggcaaccaacccggttagtcaagagacggctgttgcatcagctaaggataatttggataaggtattggctgattcagcgtcgacaaccgaccaaattatcgcggcccgtgatgcattgaaggatgcggtggcagatgcacttgaagcacgtaataacgctttgaatggtgctgatacagcaatttcgaacgcttcacaatcgacggcagcgcttgatccagatgtcattgccgcacaaaaggcattgcaagaggccgttgatagcgctaatgctgacacgggtacgacggatgcagtgacaaaggcgacagaagccttgaacaaggctatttctgatgctcaagccgaccaagaagctgcccgggcagccgctgcagcagcgattgcagcgatgacgccagtttctaatgaagcgaatatcttggccgcgtcaaagtcacttcaagatattttggataatcaaaatgcaaccgctgacgaaattaccaatgcgacaactgctttgaccaatgcgacggcgactgaaaagggaactcgtagcgatgcggtgtcagctgctgaaactgctatcacgaatgcccaagcaggcgataacgctaatgacgaaggcgttcaggaagcgattgaaaacctacaaaatgttattgctaatgcaacggatgaaaagccggacggtgacggtaacgtaccactaacggacgacattgaagcggcaacgcaagcgcttgcccaagcgatttctgatgccgcatcagcccgcgaagatgcagtgacggcagcgcaagatgcgatgagcgacacggcgccggtttcattggaaccagatacggcaacggctaaggaaacattgcaaaaggtgctagatgatccaaagtcaacagcaaccgacattgaagaagcgatgcaagactttaaggataagattgatactgtgcgtgaggaacgaactggagtcaatgacgaagcgacgactgcggtaacgaacgctcagaattcggattatgccgatgaacagggcgtgcaggatgcgattgctgccttgaaggaagcacaagaaaatgcagcaaccgataaggggacgactgctgaaattaccgacgcaatgacagcgttacaagatgcgttggatgcggctaagtctgatcagcaaaaggccatcgatgacgccgaagctgtggtgacgtcaccagttagtcatgaaacggaagttgttaacgcacaaaaggcattggatgatttgatttcttcaaccgaatccggtggggatgtctcaattgcggacattaccgacgctgctcaggcgcttcaagatgcagttgacacagcttctgagcagcgtgatactgctaacgaagcggctgaccaagcagtgacagatgctgaagcaacaaaccaagctgatgagcaaagtgtgcaagatgcgattcaagcattgcgtgatttgcaagatgcagctagtcaagatgatgaaaatgcattaacggctgacattgaagcagcaactaaggccattgctgatgctgtcgaacaggcggcagctgcacaagatgaagctcgtgatgcggctggccaagttgagacggcgcccgtttctaacgaacaaggtgttcagggtgcgcaacaagcgttgaatgatgtccttgatgacccggcatcgacggtagcagagattgaatctgcccaacaagcgcttgaggatgctgtgaagacggcgcaagataaccgtgatgccgcgaatagtgcggctgatagtgtcatcgatgacgcccaaactggcgatcaagctggtgaaccgggcgtgcaagatgcaattgctaaactgcaagaccttcaaaccaaggcggcgaccgataatcctgatgcgttgactgaagacattgaagcagcaaccaaggcggtgacgcaagctatcgcagacgctaaggccgctcaggatgcagctcgtgatgcggctggtcaagttgagacggcaccagtttcaaatgaatcaggtgttaaggatgcgcaatccgcattggataaggtgctcaatgatcctagtgcaacggtcgaggaaattaacgatgcaacaacggcactggaaaacgcagtagatacggctaccgcagcccgtgattctgcgaatagcaatgctgacacagccatttcgaatgcgcaaggtacgccacaaattaacgagcctgctgtacaagaggcggttgagaagttgcaagagttgcaaaagaatgcggcaaatgattcatcttctgctttgacacaagatattttggatgccatccaagagctttcagatacagttgccgaagcggctcgggataagcaagaagctgttctagcagctgaaaatgcattgagtcaaacaaagccggtttcaaacgaatcggcgacgtccaaagcaatatctgatttgcaagccttgttagccgatgaaaattcaactgctgaagcggttcgtgatgcaaccaaggctttgaatgcagcgactgcgagtgatacgaccgaacgtaatgcgacgaatactgaagcagctgatgccatttcagcggcccaatcgtcaacggttgcgactgatgaatcagtattgacggctattcagaatttgaaggatgcacaaaccaaggcagctaacgaaacggttgatgatgctggtcacgcttgggtatctcaagatatcgttgatgcgatgcacgctttgcaagaggcggtcagcgttgccgaacaagcacaagacacagctcgtgacgaagcatcggcattggtacaagataatagccagacaagtccggttacaaatgaaccagcgattacggatgcaaagtcagctttgcaagatgtgattgatgatccaaacgcgacagcggctgacttagaggatgccatggcagcctaccaagatgtgattgatcaaactaagacacaacgtgataatacgaagtcatcggcaacggatgccatcgcgtcagctgaggatagtgatttgtcagctgaccaaggcgtacaagatgcgattaaggcgttggaagacgtcatgaaccaagctgatgccgacagtcctgacgctttgacgagtgatattcaagacgctatgaaggcattgcaagatgcgcagctcgcagcggttgaatcgtgtaaccaagcagctgaactggcagatcaagtgaagggtcaaacggccccagtgtcacaagaatctggcgtacaacaggcagtcagcgacttagacacattgctaaatgattcaacggcaaccgcggcccaaattaatgatgcaatcaaggcgttgcaagatgccgttgctgaggcaaatgatgagcgtgacgcggttaatcaagcggctaatggagctgccacaagtgccgcaaatagcgatcagagccaatcgcaagccgtgcaagatgcaatcactgctttgcaacaagcgcaagctgatgctgcaaatgacgaaggcactagtgaagcgattgcgaccgccacgaagcaactgcaagatgcggtcgctcaggaagcagctaaccaagcaactgaacgtgacaatgctgcagctgcaatggatgcaacagcgccggtttcaaatgaaacagctgtggccacggcgaagaatgcattggaagctgttttgggtgacccgaagtcaacggctgaagaaatttcagatgctgtgaaggctttgaccgatgcgacaacagccgaaaaggagaaccgtgacactgctaacacaacggctaacgatacgattgccaatgtgccgactgaggtggcgagcgagccacaagttgcggaagcggtcgctaatttgcaacgtttgatggacgaagccgctaatgattctagtggcgctttgacgaaggatattgccgcggcaactgaggccttaacaaaggcgcaagatgatgtggttggctatcgtgaacaagctcgcgatgccgcagcggatgctttgaccaagacggcacctgttagtcatgaaccagccacggcagctgcaatcgatgcgttgaacgctttggttaatgatccgaatgcaaattatgcggatatcaagcaagcgacagaagatttgttgaatcaagttgcaacagatacacaagaacgtgatgcaacgactactgatggaaatgcgttgcttgaccaagcggcacaatcagatttggcaaatgatccaactgtggttgcggccatggacacattgcgtaacgcaatgacgaccgccgcaacggacacgagcgatgcgttgacagccgatattaaggccgccatgcaagcgttacaggatgctatgactgcgcttgttgatgatgcacgtgagcaagcacaacaagcaattgctgatgccaagccagtttcaaatgaaaagagtgtcgctgatgccattaagcagctacaaacagtgcttaatgatccaaatgcgacacgaacagcgattgaacaggcgatgactaagcttcaaaatgcgactgaatcggcgaaggaaagccgtgagaatgccaatagtcaagcacagcaagccattcaagctgccgaaagcagttcggtcagtgatgatccggctgttcaagcagccatgcaacgtttgcaagagattcttgcggcagcggccttggatgatccagataatctaacggcggatattttggcagcgatgcaggctttgcaatcagctgttgcgaaagcagaggctgaacaagctgcgacggttagtgtggcaacacaaacaagtgagacaccggcagttgtgacgcaagcgctttacggtacgacgccaatctatcaaagcggtggttatccagtcattgtgcctggtgtcctcccatacacgggctatgagtcaggcacatgggtattgccattagctcagtctttgccatatcaagcaacggcgccacgtacgctagctggtgagacgaatggtcgtcgtattgtcgaccgaatcagccaactagacgatcgagaaatcagtcgtgcgggccttgatacggcgattgcacatgaaaataggtggttgccactaggtatcttcctattctcatcaatcttgttgttacttatcgctaagcgtcgtaagcaagacgacaagtaggatataaattttaggagagtgatgtttctgaaaaatcagagatatcactctctttttatttgtggtcgcgcttcatggtaaacttaaatcagatgactttttaactagatgcaaaggagtgtcgaaatgtttactgataaaaacattgtgctcatcgtcagtgggggcgttgcagcatataagtcagccatttttgcccgcttgttgatgaagcaaggtgcaaacgtcaaggttgttatgacccaggctgcaacagaatttgtaaccccaaaaacatttgaggcactaacgcaacacccggttgtgaccgatttatttgatgcccacaatgaaagtatgattgcgcacgtcagtctagctgattgggcaaactatattttcgttgtgccggcaactgccaacattttggcgaagatggcagctggcattggggatgacgcagcgtcatcagttttgttggcccgtcacacgccagtcattgttgcaccggctatgaatgtgaatatgtacgaaaacccagcgacgcaacgcaatctaaagacgttacgtgaagatggtgttatcatcattgaaccagctgaaggcatgcttgcggaaggctatgctggtaagggacgtttgcccgaaccagatgaaattttggcacttgctgatttgaaactccgtcaacagactggtcgcttggccggcaagaaggtggtcgtttccgcaggtggtacggttgagccaattgatccagttcgattcattacgaatcgttcatcaggtaagatgggatatgcattagcacaagcagcggcggagcaaggcgccgatgtgacacttgtatcatcatctgagttgccagcaccagttggcgttacgatggtgccagttcaatcagcgcgtgaattgttggcagcgatgacggatcattttgacgataccgatgtggctatcatggctgcggctgtgtctgattaccgtgtggcgacaccggcagatcaaaagatgaagaagaacgctgatcacgctggtttgacgattgatttagttgaaaatccagatatcttagcgactttgggtcagcaaaagaccacccaatatttagttgggtttgcggctgaaacgcaagatttgttgacgtatgcgcaaaataaactagaaaagaaaaatgcggatatgctagttgcaaatgatgtgtcaaaggcccaagttggatttggacatgacacaaatgaggtaacgttgctgcaacgaaatgctgcgccagaaaagttgccactccaatctaagctagcgttggcccgtgatattatgaatcgcattgcatcacaagtggaaggaaaataagaaatggcagttattggaattgataagatgagctttttctcaccacaccaatatattgatatggtggatttggcaaacgctcgaaacgaagaaccagataagtacttgattgggattggtgaaacagaacaagctgttgtgccacctacccaagacgttgtcacaatggcagctaatgcagctgatcaattattgacagctgaagaacgcgcggaaattgacacgattatttttgcgactgaatcaggtattgataactcaaagtcagctgctgtttatgtacaacgcttgttgggtttgaatgaatatgcacgcacaatcgaaatgaagcaagcttgctatgctggaacgtacggtttgatgcaagcgcgtgactacgttgccttgcacccaggttcaaaggtgttggtcatggcatctgatattgcccgttacggtttgcacacaccaggtgaagtgacgcaaggtgccggtgcagtggcaatgttggttactgaaaacccacgcattctagaattgaaccgcgacaaccaattcatgtcacgtgatgtgatggatttctggcgtccggtttacgctgaagaagcgttggttgacggtaagtactcagctgaagtttaccgtgagttcttccgcgatttgtggtcacgttacaaggagaagacaggtcgttcaatcaatgactttaaggcctacgcattccacttaccattcacaaagatgggcttgaatgccttgcgcgacattttgcctgaggctgatgaagctaagcaagcggacttgttaaatgaatttgaagcaagtcgtgtttacaacaagcgcattggtaacttgtacacaggttcagtttacttgagcttgtactcattgttggccaactctgaagacttagctgcgggtgaccgtttgggaatcttctcatatggatcaggtgctgaaggggagttctactcagctattttgcaaccaaacttccgtgatggtttgattgctggtcaaatggacgctttgtttgagaagcgtgagtatttgactattccagcttatgaggaagtgtttatggctggcttgcacggttcagaggatcgtgagtttgatatctcagctgatccagccaagtttgtgttggctggtttgaaggatcaacaacgccaatacgtggcacactaactccgagaaaaaatcaataattatgcgtggcttcatcaaacgcgctgggtacactaatcgcaaagactagtacagggggaagtgcctatgcaagattatgagttacaagttggcgacttggcccattgcgatgaagcaaagggcattgaccgcccgttcattgggaaggtcgtacgctgtgaggggcagacgtacgatatggaagtggtatacattccggatttgacgcatgcgaatgcatcgttgttgcacactcaggttcaggtggccaaaacagcttcagcaccatttgccaataaggcggatgtgccatttatgtaggtgttgcttgttcgctattcgtcgggtaaaattattaggtaagactaaataataaaagttagatgaagagggaattttatgaagcgcgtctacctagccggtccattttttgatgatgaccaaattgatcgtattgaacgtatggaaaaggctctagcagccaacccaacggtgtcagaattcttcagtccacgtactgagcaacacgacgaattcgagtttggttcaaaggaatgggcaaaggcaatctacaagggtgataaggatcacttggatccagccgaagttgtgattgctgtaattgactatgagggtgaacacgttgatccaggtactgcctgggagattggttactcagaagcaacgaagaagccagttatcttggtgaaggaaaaggaaggtggcatcaacttgatgatgtcagtgccagctcacgcctttatcacggatgttgcggatgttgcaacgtacgactttgatgcattgccatcaaacgaatgggaaggtaagactttctaattctggttttacgtaaaagaagacctaacataaacggtactcacaaaaagtgggtgccgttttttgctcgaaataaggtacactgttctaagacattatttagagaaaggacatgacaacatgcaaaaactaggccggttaatgttggcatggattacaaaactctggatgccgttggcgattaccgttggtatgttggctgtggcggtttctgtcacgacggtgatgctgtataagcaacaaataacggtgcaaatccccaacctaacgcttcgtgaaaatcgaggtgtgacgagcacaccgatttcagtgctaaagcagggtgagcacttacagattttgcaagaaaacgatggttggtaccaggtacgtcgtgaagatgaatcgacggggtgggtagctagctggttgctagaacgtacaaagccgttagataaggttacgccgttgtcggaagcaacgattgttttagaccctggacacggtggtaacgatcctggtgccaagtccaatagtggcaaaatggaaaagacgtatacattgttgttggcgcaacgagtggcaaaaacgctacgggcaacaggcgctcgggtcattatgacgcgtaatagtgataaacttgtttatctttcacaaatcccaaaggtggctgagaatgcaaacgcagatgcatttatttctttccacttcgattcagtggacgaagcaaataccgcgagtggctttactgcatattattatcacaaagacaatggttctaaggacctagcgcaagcaattaatgatgcgatgaatccgaacatgcctttggagaatcgtgggattgaccgtgctgaatatgtggtgttgattgataacaaggtgccagctactttgctggaaaatggttacatcaactcagatcgagactttaaacaaataaagagcccagcttaccgaaagttgattgccaaagacgtagcccaagggttggaaacgtattttgacaatcgggtaaaaaccgttaattagtcacagattgttaggggttattgatagtattattcgtggaatttcgataccatttctttgatggggaatgtgtttaggaacgaggcatttaatatgacagcgattaatactgataatgaagtggcaatggaagtcatgcgcttggcaggcgttgtggatgaaattgcttatcatctaacgaatgtgatgtttggggatgaaccagtcaatttcgacaaggcggccgtgacggcggccttgggtgacttgggcattcaattgcgtaattttgtagacgctgaagttggtcagacgcaagaacatagtttggccacgttgaaaaatcaaattaacgacatgagtgcggccttcttgcaattcgataacgcagccgactggcaagccgtttcggcggtttcaaaccgagttaccgaaatggaacgtttatacgctcgcttaatgtgctacacggtggcaccatagaccttgacgcaatttactttctattggataataaatcccatagataaaccgatgagaaagcaaacttgtggttggtagaagaaagcgagcagggtctggtgtaagcctgtggttactgaagcaaggggacactttttaggtcgcagcaatgcgcgtgttgccacgttacggcatgagaccaaattcaaggtggtaccgcgctaaaaggcgcccttgacgatacatgaagtgtcgttgagggcgccttttcgttttgcaccatcggaaacatgagaggaattttaaacatggctaagcaatcattccaaaagccaaagggaactgctgacttgctccctggtgaatcattgaagtggcactacgttgaagagacggcgcgccttttgttcggcgactaccaatactcagaagtgcgtacgccgatttttgaaagctttgatgtttttgcccgttctgctggtgatacatcagacgttgtgacgaaggaaatgtatgacttcaaggataagggtgatcgtcacgttgccttgcgtccagaaggaactgccggtgttgtccgtgccttcgttgagaacaagttgtttggacctgaacaccaaaagccatacaagatgttctacattggaccaatgttccgttacgagcgtccacaagctggtcgtatgcgtcaattccaccaaatcggtgtggaagcgttgggttcagactcacctgctttggatgctgaagttatcgcaatggcagttgatttgttccaaacgttgggtgtgacaaacttgaaggttaagatcaactctttgggtgacaaggaatcacgtgaaaactaccgtaatgccttgattgacttcttgaagccacactttgatgagttgtctgctgactcacaaacgcgattggagaagaacccattgcgtgtcttggattcaaaggatgaaaaggatcaagcaattgttgctgatgcgccatcaatcttggattacttgacggaagatgctcaagcacactgggaaaaggtgcaagcctaccttgaagcgatgggaatcgattatgaagttgatgccaacgttgtccgtggtttggactactacaaccacacgattttcgaggttatgacacaatcagctgcgctaggtcgtggttggacgacaatcactggtggtggtcgttacaacggtttggtcgaagagttcggcggacctgaaatgccaggtgttggatttggtatcggacttgagcgtttgatgttgttgcttgaagccgagggtgcaacgttgcctgaacaagcaccattggaagtttacgttgcaaacatgggtgaaggtactgatgttgcggctatgcaaatggtccaagcagtccgttcatttggttacagcgcagaacgcgattaccaagatcgtaagctaaaggcacaatttaagacggccgacaagcttggcgcacgtttcatcatcacgattggtgagcgcgaattggctgagcaaacggctaacttgaagaacatgacaactggtgaagaaatcacggtgaagttggctgaactttacacgggtctcccagagtttattgaagttgaagaagacgtagaagaggaaaactaattatgaagcgtactaactatgctggcttgattgatgaagcctaccttgatcaaactgtcacgctacaaggatgggtgcaaaagcgccgtgacttgggtggtttgattttcgttgatttgcgtgaccgtgaaggtatcgttcaattggccttctcagaagaatttggtgcggatgctttggcggttgctgaaaagatgcgttcagaattcgttattgaagttgaaggtgtcgttcgttcacgtgctgagggtgcggttaacgacaacttgaagtcaggtaagatcgaagtgcaagttgctaaggcaacgattttgtcagaagctaagacgacgccattctatattgaagacgatatcaacgtttcagacgaattgcgtttgaagtaccgttacttggatttgcgtcgtcctgagatgcaaaagaacttgcgcatccgttcaaagattacggctgccacgcacgaattcttggatgccaacggctttatcgacattgagacgccatacttggccaagtcaacgccagaaggagcgcgtgactacctagtaccatcacgtgtgtaccctggttcattctacgcattgccacaatcaccacaattgtttaagcaattgttgatgggtgctggctttgaccgttactaccaagttgcccgtgccttccgtgacgaggatttgcgtggtgaccgtcaaccagaatttacgcaattggacgttgagacgtcattcatgacgcaagacgaaatcatggcattggttaacgaatgggttgccgctatcatgaagaagacggttgatgttgatttggatacggcccaaattccagtattggattacgctgattcaatcaagcgtttcggaactgacaagcctgacatgcgtttcggcatggaattgcaagatttgtcagagttgatggttgattcagaatttggtgtctttgctaacgcggtaaagaacggtggccaagtaaaggcaatcgttgtacctggtggtgctgatcactactcacgtaaggacattgataagatggcccaatacatcgagcgtttcggtgctaagggattggcttggttgaaggtgactgatgaaggtatcactggaccaattgctaagttcttgacgacgaagggtgacgatttgttggctcaaactgaagctaaggccggcgacttgattttgttcgctgccgattcagaaggtgttgtgtcagcaacgttggatgctttgcgtcgtatgacagccaaggaaatggatttgattgacaacagcaagtgggctttcgcttgggttgttaactggccattgttcgagcaccaagctgaagaagatcgttggattgctgcgcaccacccattcacaatgccaaatgaagaagatttgccattgttggagacgacggaaggtgctcaccaagcacacgcccaatcatacgaccttgtgttgaacggatacgagttgggttcaggttcaatccgtattcaccgtatggatatccaagaaaagatgttgtcagctcttggcttcactaaggaagctgcgcacgacgcatttggcttcttgcttgaaggtatggaatacggcttcccaccaatgggtggaatcgccctaggattggatcgtttggctatgttgttggctggacgtgacaacatccgtgaggtgattgcgttccctaagaactcaaaggcaactgagccaatgacagaagcaccaacacctgttgcgaaggcacaaattgttgatgacttgggcttgacggcgcctgtatacgccgacattgaagcaccaaacatgtcagaagaataattagataattaaagcgcacgtttgcattgttttgcgaacgtgcgcttttttatttgtcaatcgatattcctattaatagtaagtcaatatgtttcgaaaatagaacagccgagattgtcgcatttcatattttgttcataattcatctttatactttttgttagtgataaagataagtaagtatcttttgttagagaatttggattaaaggaatttggggaattgtgacatgttgaattggcgtaaattagcattatcttcagctgttgttctaggaatgatgactgtggcagggactgtctatggttctgatgatgtttttttgaatgagaatagtcacatggtcgtaagagacttagataatgcaaccaaggtaacttggaattcaccgttgtatacgtctaacatggacgctttgaatacgaagctgggagaagctgatgttcgtgctgaaattattcgtgaagcaggattcacaataaacggcagccgggcaatggattggcacgcggagaaggttgttgttaacggaacaaccttcgatggttatctaatgttcaaaaacgaacgtatggcgacggttgccacgactgcgatgattgtggtgaagtttaataacgttaatgacattcaattccaagtcctgtacaagactagcggatcttcagatcaaacagaggcttggtatgcgacccaaggaatgtatgttggtattcaacaaggtaatcgtccggaaacaccggaagagcctgaagcaccaacaccggaagaacctgaacagggtattacgacattaccaatcaagaaacctgttttttctggagaggatcctactcaactacaagatcctggaaatattaacattgccggtaataccgtaggtggcacgcctaataagctaccagcagacgcattccagaagcaggatccgcagccagcaaggccaccaaagcaaaagccaatacaaaagccaggaaagccagtacaaaagccagatacgcaaccagctgacgcgttgcaaaagccggatacacagccagcagatgcattgcaaaagccggggtatggggctgttccagcgccaagcacgcctgaccacggtcaacaaacgattgacggcaatacagaaggtggtaggcctgatacgggttacatcgcagcgccaagcatttctggtgaaggcgattcaaacgtaacgggcccagacgcaccaactgctgacaatcaaaacgacgcaaatgactcaaacgggtcaaatggtgtaaccacgtcaccagttgctacgccggatggtgcacaaactgattccgtgacaaacgggacactaggatttgtttcagcgggtgttaacccaattgcacgcgctgcggtgttcggcaatgatgcagcgatgttgtatggtaataatgcagcatcaagtcaacaaacgttgaacccaggctcatcaaacggcaaccgaactcgtctagggggttcaaataccggtcgtgatttgattcatgacatgattgtgtctgatgacgccaagcgttctaatgcgttgaagatggaacaagctggcgttggttctgaatggatcacaatggttgcaggcgcaattctaggattcctattcgcattcttccgtcgtcgcaaggaagatgagcgtaatgaagaaaacgaagcataatagttaaagtatgacgaaaacttacgggcattggtccgtaagttttttatttatatcggcattttcgtgctaaaatcataaagtacaaattgaaagaagcgagaaaatggaccagatagaacagtattttaatcgacaccagtactcaagtcgcattggtagtgcgatggtatatgcagttgcttcagcgattgcattgaactttttttggacacccggacacatttattcttctggatttacagggctagcccagctgctaaacacattgcttgaacgctttgtggggtggcatgtgccagttggtgtcttgttggtgctgattaacgtgcccctaatgattactgcgtaccgtgcaattggtaagcgatttgcgatgtttacggcgttggctttgttgctggccgcgattgccatgcgtttggtttcgcaaccagaacaattatggacgcacgatccgcttgtaatggccatctttggtggggctgtcaatggattcggaactgggttggcacttcgtaacggactctcaactggtgggttggatattatcggtatcctggtacgtcgtaagactggcatgaagatgggagcagtgaacttaacgtttaacttcttcatcttgttggcctcagggttcttgtttggtccacaatatgcgttgtacaccggtattgggctggttatcaacgcgcgcgtgattgatttggtttatacgcgtcaacaaaagatgcaagtgatgattgtgacggaaaagcctgatttggttatcgaagccattcaacgtgatatccgccgtggtattaccatcgtgcaccacgctgaaggtggatataaccaccaccacaaggaagtcttgttcacggttatctcaatgtatgagcaatatgacctacgtgatgccatttatgaggttgatccacaggcctgggcatcactttggcacatcgaccgcacgttcggtcgtttctacgaaccaaagttgtaagctaacggtttgttaggtacaaaaagcttaggtacaaacattttaggtgtgactaggtgaagagtgataacaaatcgtcagcagttttgtataaagcgttgacaacaggttcaattctggtaaactattaaagaacaaaagtgtgcgacatatataaaagttggaaacttcacacgggaagggagggtaaacattatggcaaagactgttgttcgtaagaatgagtctcttgatgatgctctccgtcgcttcaagcgtggtgtatcaaaggatggtaccttgcaagagtaccgtaagcgtgagttctacatcaagccatcagtacaacgtaagttgaaggctgaggccgctcgtaagcgcaagaacaagaagagccgttaattcgactcttgccgggctacctgctggtggtccggttttgttttatactcagaaattattcaaaaacaaaaaggagataatgactatgagtttgttggaacaattgactaacgacatgaaggaagcaatgaaggctaaggacaaggttactttgggcgttgttcgtatggtaaagtcttcagtttctaacgagcaaatcaagttgggtcacgacttgactgctgacgaagaattggctgttttgtcacgtgaaatgaagcaacgtgtcgaagagctggaatcatacaaggatgctgatcgtgaagatttggctgaagaaatccaaggccaaatcgacgttttgaagcgttacatgcctgagcaaatgtcagaagaagaagtcgttgccgttgttaaggaaacgattgctgaagttggtgcatcatcaaaggctgacttgggtaaggttatgggtgctttgatgcctaaggttaagggtaaggctgacggtaagttggttaaccaaactgtacaatcattgttgggctaatcttagtcgaactctgatgcgggggatgcccccgatacatatctatttgcggtataatagtaactgtaagagaataattcgaattagagggattacatttttggcagcacaagttgaaaaagtttatcgttttgaaaatgctgagcaagaaattggtttggtcggcgcacaagacagtaatttgaagttaattgaagaaggcatgcatgttgcattgtctgtgtttggggaccaacttacgattaagggtgaagctgacgcagttgatgctgctgaagcaatcgtcgctgaattggccgctttgattaaaaaaggtatgaagctaaacgcaacggatatcgtctcagcgatgaagatgtcagaacgtgggacgttggaatactttggtgatatgtacacggagacgttgattcgtgatgccaagggacacccagttcgtgttaagaactatggtcaacgccgttatattcaagcgattcgcaataacgacattacgtttggtattggtccggctggaactggaaagacgtatttggctgttgtaatggccgtggctgctttgaagcgcggtgatgtggagaaaattatcatcacgcgtcctgcagttgaagctggtgaaagccttggtttcttgccaggtgatttgaaggaaaaggttgatccttacctacgaccaatttacgatgcgttgcacgctattttgggtgctgagcatacggaacgtttgatggatcgtggtacgattgaaattgcgccattggcctacatgcgtggtcgtacgttggataatgcctttatcattttggatgaagcgcaaaacacgacgccacaacaaatgaagatgttcctaactcgtttggggttcggttcgcacatggttgtaaacggagacgtttcacaaatcgatttgccaagcaaggtgcgttcaggcttgattcaagctcgccgtgttttggtaaatgtgtcacacatcgaattcattgagttcgcagcggatgacgttgtgcgtcacccagttgttggagcaattattaatgcatacgacgcctttgatgcagcccaagaaaaggcaaaagaagcaaaagagaagaaggattaagattatggatttggcaattattgaccaatcaaagcctggcgttcctgccgagcaaattgaccttgttgaaaaggttttggactatgctggtgagtatatgaagttgccagcagacactgagatgtcagtaacattcgttaacaatgacgaaattcaacgttacaaccgcgaataccgtggattggacaagccaactgacgtcatctcatttgccattgaagaagatggtgatgatttgccattgatgatggatgaagagatggccgaggatttggcgaagaacattggtgacattatcgtttctgtcgataagattggtgaacaagcggaatacttggaacactcatatgagcgcgaactaggattcttggttgtgcacggtttcttgcacttgaatggttacgaccacatgcgcagtgatgaagacgaaaagattatgtttgatttgcaacgtgagattttagatagttatggacttacacgataagaaaaaggctgctacacaagagccacaaattgagaaaaatacgcacttcatccaagcccttggtcatgccttagaaggtatcggtcaacttttggttcgtgaacgaaacatgcgttttcatattgttgcggcgattgtagtcttacttgtcggcatctatgttaaactaggacgttcagattggttgtggatttcagtcgccgtctttacggttatcatggctgagttcgtgaataccatggttgaagccatcgttgatttgattgtgggtgaacaatatcacccgctagccaaggttgctaaggacgtggcgtctggtgctgtgttggcagcggtggcatttgccattgtgattggtgttttgattttccaaccatacattttgccaaatttgcagatgattattaaataagttagttgtacgcgcgatgcgtggattatagaaagaatagagaataatatacatgagtgaacaaggatttaagtcaggtttcgttgccctagttggtcgtccaaacgttggtaagtcaacgcttttgaacaagatgattggtgaaaagattgccatcatgtcaccaaaggcgcaaacgacacgaaacaagatccaaggaatttacacgacagatgaaggtcaaatcgtgttcatggacacaccaggaattcacaagccacacaactcattgggtgacttcatggtgaagacggcgatgtcagctttgcgtgaagccgacatggtttggttcttggttaacgccgacgagccacgtggtgctggtgatgacttcatcatcaaccgtttgaaggacacaaacacaccagtttacttgatcatcaacaagattgatttggttaacccatcagacttgttggcaattattgctgattacagccaacaaatggaatttgcggaaatcttcccaatttcagctttgaagggtgacggtgtgccagagttgttggacttcgccatggacaagatggaagaaggaccacaatactacccagctgaccaaatcacggaccacccagaacgtttcatcatgagtgagttgattcgtgagaaggtgctacaattgacgcgtcaagaagtgccacactcagttgccgttgtgatcgacaagattgaacgtcaagatgagaaccacttgcacgtgcaagcgacaatcgttgttgagcgtccaacgcaaaagaacatcgttatcggtaagcaaggtgcgatgatcaaggaaattggtgttcgtgctcgtaaggatatcgaacgcttgcttggtgacaagattttcttggagacgtgggttaaggttgaagaacgttggcgtgataagccacaagccttgcaaacgtacggttacaaggaagattcagatatttaatgatgtgaaagagagactgattggtctcttttttattaggaggcggcatggcggaagtatttgaagcgattgtcatgtatcaacgtgaccacaaagagaaagacttgatggttaaaatgctgactaaaacggccggcaaacgcatgttttacatcaaaaatggtaagtctaagcgctaccagtttgctgcagatgttcaaccgatgacgattgcaaccttcgaaggcacgctaaatcaaacgggattgagtttcatcaattcggttaaagagagtcaccattcgcgtgagttgatgatggatgttgaaaagaatgcctacatgacatacattctgggattgattgacgcagcgtttgttgataatcaaccaatcgaaaaatggttcaactgggcaaagctggcactggaaaagttggaggaagggcttgatccacaaggcttagcgaactactttgaagtgcaactgctaccggcgtttggattaaatccaacttggggtgaatgcgcagtttgtggtcgtcgcgatttaccactcgatttttctgagaagctaaacggcacgatttgccaaattcactgggatcaagacgaaaatcgtatgaacgcaaatccacgctcagttcgtatcttgtcacaacttgcgaaggttgatttgaagcaactgggcacgttaagtctaaaagacgaaacaaaacaagatatggcgcgcgtgatggacaagctatatgatgatcaagttggtgttcatttgcgggcaaaatcatttatccaacagttatcaggctggcaggcacgcttaacaacgcgtggacaggccgagtcaaataacgagacatccgaagactaatcacttataataaatgtgtagaaagaaaacgttttcagataggagatggttctatggacattaatttggatgatttgaaggacaaggcagctgacgtacttgaaggagctgacttgaacgatttgaaggataaggccggcgagttgcttggcgacaaggctgacatgcttgataacgttgatttggatgacgttaaggacaagctatcaggattgcttggaaaagattaaacaacagttaatggacgacatgctcgattgggtatgtcgtcttttttcgcatcccgaacactaacgagttacagtcctgtgacattatgcacaaacgattagttaatgtgataatctatttcttagtgttttagttttagggagtagtagaaagatgcagaatttgaagcgagctttgcgtgaggcgacgtcgccaactaacatcagacgcgacttggcattgatgaatcgattccaacgtgtgtacatggttgttatcatggcagtgacggtttgggcgtttgtttatacgggtgattattcatcatctggatggacgagtttgattaccggccttgtcttggcattctatttgattatgttggccagtggtcgtttgacgaacttcttctggggattgttgacgaacggtatttggctattaatgtcgattcacaatcacttggttggtgatattttgaaccaaggattcttctttgtgatgcaattcgtggggatggcggtgtggtacaagcaattatcacaacaagctgatcacagccaaattcaggcgaagcgtatcggtccgaagatgatgggctgcctagtcgcaggggcagttgttgtttacggtattgtgttgacggttgcgaagacggctcacggtaatcaagtttacctggactcatctcaactaccacttgggatgttggcccaaattttggcaacgtacggctacttgtcacaatggattgtgtggttatttgttgacgccgtgggcttgctactttggtggaatcaaattcaggcaggcggttctggtgcattggggatgtttgtcctgatgattgtgaaaactttcaatgccttctacggcatgtacttgtggtcaaaaacaaccgaatatcaagattaattatgatagactggcaacattttgttgtcagtcttttttaatctgaaggacgaagcggaccgtggtaatatgcgcaccagcattcataattaatcagtcatgcgcgttgacttttaaacgctgagtgataaacttattacatgtaataagcgatgaaagcagaagaattacgtgaactcagtccagcaagtcaccggtgatgtgagggtgatctgaaaacacgcaaggggcactgccggagcacaatttaatccaatgaagctgctaggagttttcctagaagtagggtggaaccgcgaattatcgtccctacatcaatcatttttaaaggtgattggtgtagggctttttatttgctcgaagccaaccacgagaaaggaatttgtcaacatgagtgcaaaaatgagtgtgcaagacattattttgacgttgcaaaagttctgggctgatcaaggcgcaatgctaatggaagcctacgatacagaaaagggtgccggtacgatgagcccttacacgttcctacgtgccaatggtcctgagccatggaacgcagcttacgtagagccatcacgtcgtccagccgatggacgttacggggataacccaaaccgtttgtaccaacaccaccaattccaagtggttatgaagccatcacctgacaacatccaagaattgtacttggattctttgaaggccctgggcattgatcctttggaacacgatatccgtttcgttgaagataactgggaaaacccttcaatgggtgccgctggtatcggttgggaaatctggttggacggtatggaagtgacgcaatttacgtacttccaacaagttggaggaatccaagttgatgccgtaacatcagaaatcacgtatggtttggagcgtttggcttcatacatccaagatgtgccaacggtttacgatttggaatggggtaacggcgttttgtacggtgacatctttaaggagccagagtacgagcactcagtttactcattcgaagagtcagaccaagaaatgttgttgcgtcactttaacgagtacgaagctgaagccaagaaggccttggaaaagggcttggttcacccagcttacgactacattttgaagtcatcacacacgtttaacttgttggacgcgcgtggaacggtttcagttactgagcgtgcaaagtacctttcacgtatccgtaacatggcccgttcagttgcgcgtgccttcattgatgagcgtaagaagcttggtttcccattgttgaaggacgaagctttgcgtgcgaagtacttgcctgcagatgaggaggagaactaagatggctaactttttgctagaaattggtttggaagaagttcctgcccacttggttacgcccgcaattaaccaattggttgagcgtgccgaaaactttatgaaggatgagcgtttggattacgagtcaatcaagccattctcaacgccacgccgtttggcagttttgatttcaggtgtggctgaaaaggctgaagacttcactgaagaagtaaagggacctgctaagaaggctgctttggacgctgaaggtaactactcaaaggctgcccaagggttcgtacgtggtcaaggtatgacgaccgacgacatcacgttcaaggaatttaacggtaacgaatacgtttatgtgacgaagttcgaagctggacaaccagcagctgctgttttggcaggcttcaagtcagttgttgaggcaatgacgttctcaacgacaatgaagtggggtcgtcacacattcgaatacgttcgtccaattcgttggatggttgcattgttggatgatcaagttgtgccatttgatattttgggtgttgcaactggtcgttcatcacgtggacaccgcttcttgggtcacgatgttgaaatcgcatctgctgacaagtacgaagaagctttgacgtctgttttcgtgcaagctgatgctgaagcacgtaaggaaaacatccgtgcacaagtgcgccaaatcgctgctgacaacaactggcaagtagttgttgacgatgatttgcttgaagaagttaacaacatcgttgaatacccaacggcctttgctggtggcttcgacgaaggttacttggaagttcctgacgaagtattgattacgtcaatgaaggagcaccaacgtttcttccacgtggttgatgctaacggtgctttgttgccacactttatctcagttcgtaacggaaacgctgaacacatcgacaacgtgattgccggtaacgagaaggtgttggttgctcgtttggaagacgctaagttcttctaccacgaggatcaaaagcacgatatcgacttctacaacaacaagttggaagttgtttcattccacgctaagttgggatcagttgctgcacacacgcgccgtgccaaggctttggctaccattatcgccggccgtttgaacttctcagctgaccaacaaacaaagttggctcgcgctggtgagatttacaagtttgacttgatgactggtatggtcggtgagttcgacgaattgcaaggtatcatgggtgagaagtacgccaacttgtttggtgaagatgctgccgttgcccaagcaatccgtgagcactacatgccaatctctgctgatggtgaattgccagcatcagatttgggtaagattttggctttggctgacaagttggatagcttgttgtcattcttcgccggtggtatggtaccatcaggttcaaacgacccatacgctttgcgtcgtgccgcttcaggtgttgtaaacattttggccgacaacaagtgggagttggacattgacggtatcttgtcagacttgattgatgacatcaacgctgatgctgctaagtttggtttgccagaagacgttatggctgagttgcaaaacaacgtggctgccgtggtgaacttcttgactgaccgtgttgtgaaggcgttgcaagatgatggtgttcgtcgtgacatcatcaacgccgtaacaaagaacgactttgctgatacgacacaaatgttcgaatcagcgcaagttttggcagctcacgtggctgacgataacttccgtgaaggcgttgaagcgttgacgcgtgtcatgcgcttgacgacgaagaacgcaactgactctgttgttgatgtaacgttgttcgagaacgatgctgaaaaggctttgttcgaagctgtttcaccagttgctgaagttgcagaaacggatgctaagttggttgctttgttgaacttgcaaccagcagttgcagcttacttcgatgagacgatggtcatggtcgaagacgaagcggttaagaataaccgtttggctacgttgcacgctgttgctaacgaagctactaaggttgctaacttcctagaattggacgttaagtcaaactaatcattaattaatatgagagccaggcaatttcttgcctggcttttttgcatataaaaacgtcattcgaaaattgttcacaatgccgtgataacctgtgtttgatgaagatgatagggggaaatatcatgacgagttttaaacaggtttggcacgcgaaatggccaatgattgtgggactgtttttgtttgtatgggcgattgaatcatttagctactttgttgtggcgacttgggctggcggcgtacacggtggcgtcgcttcagccgttaatttgcagttaggcattgatcgcgtcataccttggttcacgccgatttttgcactgtatatgccattgccatttatttggattattttgtggccagtcatggcctggtttgctggccgagagcgattgttttggcaatacttcacggtgagttcgctggtgtatgtgatttcgacagtgatttatgccgtgatgccaacggtgacaattccacacgactttttggttgggccaattcaagtgttgtcaaaagatagtgcattttatagtcaaattgcagtgcttgattcatcatctgtgaatgtttttggatcattcccaagttatcacaatacttgggctgccttagcggtgttctttggcgttgtggcccttcgtgagcaccggtccgtactcgggactatctgtgttgtcttcggccttctaattacgttaagtacgttcttgttgcaccaacacgcggttttggatgccgtgtttacatacgcactagttggtttgtgctggtggttagatgccaagttcgggtggtcacaaaaattaacgcaagataagtcgtagcgtttgaaatctattgtcaaaaagttggtaatagtattacgattaatattcggttagaatagtcttatagtcattgcggaccaaattggtggcccgagacgtatctatttataagaaagttgagaaatacatggaagttggtataggttattggattggtttcttcgcctttgttttggtgatgttggcacttgatttgggtgtcttccacaaaaataatgaggcaccaaccatgaaagaatcattgttgtggagtgccttttggattgggcttgccttcatttttgcaggaggcctttggttcttcacaggcggtgatcatgcgcttgatttcgtgacggcatacttgcttgaaaagtcattgagtattgataacttgtttatcttcattttggtatttggtttcttcggtattgaattgaagtatcaacaccgtttgctattctggggtgtctttggtgccttagtgatgcgtgtgattttcatttttggtggggcagccttgctacaccatttcgcctggttgatgtacatcttcggtgcgttcttgattgtcactggtgtgaagatgctcttcgaaaaggaagaagcgcaagatttgaacgatagcttcattatcaagagtttgcgtaagattttgccattgaaggaagatgtggctgaaccgcatttcttggttaaggaaaacggaaagcgttacgcaacgcaattcttgttggccttgttgttcattgaagcatcagatttgctgtttgctgttgactcaattccagccgttttggccgttacgcaagatacgtttatcgttgtgacgtcaaacatttttgcgattatgggactgcgttcattgtactttgctttgtctggtattttgccaatgttccgttacatcaagtacgcattggcggtcatcttggcctttattggggtgaagatggtcttgaacgaatcagcgaaggcattcgattggcacttccacatttcaaacgtggtgtcattgactgttatcgttggcttgttaacactatcaattattgcgtcagtgattgtatctcgtgtacaagagcgtcgtaagtttaaggctaaataacagttttgggatctaccttttcgggtaggtccttttttaattctgctatcgatttttgcgcgtatactgacgatattaaatttgtaggggatataaaaatgacaaagcaaattattacaacaacgaatgcgccggctgcaattggcccatactcacaagctgttttgacaaatggaacgttgtacgcttcaggccaagttgggttgattcctagcacaggtgagtttgccggggagacgaccttggatcaagcaacgcaagtctttaagaatattgatggcttgctggctgcggctgacatgacgcgtgcggatatcgtgaaggtgagcgtttacttggctgatatggctgatttcgcgccagtaaatgagttgtacgccgaatactttagcgacgtcgatgcattcccggctcgttcagcagttgctgtggcaacgttgccaaagaacgcccgcattgaaattgaagtaattgcgaataaataggtaattaaagcgtatgcgtctgtcgatgcatacgcttttatgttataatgtaagcgtttactgaaagatatttaatgaatgaaagcgagatcaaccatggcattggaaaagattttatttggtacttatacgcgacgtgtttcaaagggaatttacgaagcagcattgaacacggagactggtgagttgcaagatgccaagttggttgctgaagttggttcaccaacataccttgctttgagcaaggccaacaagttgtacgcagttgacaagaacggtgaccaaggtggtgttggtgtatttgacttcgccaatgacgaagcaacgttgacacaagaagtattggcagaaggtgcttcacctgcgtacgtcgctgttgatgaagcccgtcaattgttgtactcaggtaattaccacaagggtacgttggaagtcttcgcgattgcagccgatggttcattgacgttgacggattcattccaatcagaaggctcaggtccacgtccagaacaagggtcatcacacgttcactggaacaacttgacgccagacaaccgagtggcagttgtggatttgggtgctgacaaggtgttgacgtttgatgtgtctgacgaaggtaagttgacgttggttgcaacgtttgagaccgaagccggctttggccctcgtcacttacgctttagccctgatggtcaatacgcttacttgttgggtgaattgtcatcaaagttgtcagtattgaagtacaacgctgacggatcattcacgttgttgcaaactgtttcaacgattccggctgattggacggagcacaacggtggtgctgctatttacttgtcaaacgacggtaagtttgtttacacgtcaaaccgtggtcacaactcaattgctgtttttgcggttaaggatggtggtgcatcagttgaacacattcaatggatttcaactgagggtgatttcccacgtgacttcgcgttgaacccaagtaacgagttcttggttgcagctaaccaaaacacggacaatgtgacggtttaccgtcgcgatgctgagactggtgaattgacgttgtcacaaaaggactacgaaattcctgaatcagtgcgtgtattgttcatttaagcttgatacaataaagtcagttgccagttggtaactggctttttatttttgggggatagactatatgagcaacaaccaaaaacaccggtcgattttgtatcgctggctgttagataacaaaatcatttcaacgatgctggtaattttactgattttggccattatttatatgttaaagaaggttgatttcatctttgcaccagtcgctggcttgttcggcgcagtgggggcaccgattattatcgcgggtgtcttttattacttgctaaatccgatggttgattgggctgagcgtcgctttaagcttcatcgtgccgtgacgattacgattcaattcgttgtcttggctttgttgattgtttgggggctggccgtattcattccttggattacggatcaagttgctggactgattaaacactggccagagtactggcgcggtattgttaagaccgttgataatttgacatcggacaagcgatttgtgtcggtcaataagtggtttaatgaaaccaacaatgacatcacaacctggtttaaacaatactcggcagaatatgcaagtaagggaatcaagggcgtttcgtccgttgttggaacagtaacaacggttgtcatcaccttgttgacattcccgttcatgctattttacttgttgaaggatggtcaccaaatgcctggatacatggcaaagtttttgccaccacaggcgcgaccatctttccttgagacaattggtgaaattaacaaccaaatctcaaactacatccgtggtcaattgtcagtcgcgtttgctgtcatggtgatgtttgcgattgggtatacgattatcggattaccatatggttggttgattgcgattgtggcgggtgtcttgaatttgattccgttcttaggatcatttttggcaatggtaccagccgttgtcgttggattattcgtttcgccaatgatgttggtgtcggtactagtggtctttatgattgaacagactttagaaggccgactcattacgccgaagctgctagggaattctctacagattcacccggtcacagtgttggttatcttgttgtcagctggtaacatttttggtttggtaggggttatttttggaattccagggtatgccattctgaaagtgttgttgtaccgtttgtataagtggtggcaggaaaactcaggactgtttacggaagaaaacgagtaaagcatttaataaggtttactaagtatagcgtggtcagttatcagaccatgctatacttatttttgtatgcaattaaacgcgttgggggaggggagccttcccagaataggagaaaatcatgagcacgaatcacatcgtattatttgagccattgatgccagcaaatactggaaatatcgcccgtacggcaacgggtactaacacaaagcttcacttgattgagcctttgggatttaagttggatgacaagcacgttaagcgtgccggattggattactgggatacagttgatattacaatccacgagaacttgccagcctttatggccagcttgaaggaaacagatgaactgttcttgatttcaaagttcgcaccacgtgcttatcacgaagctgattacacaaaccctgatcacgattactacttcttgttcggtaaggaaacgactggtttgcctgagccattcatgaagcaacaccctgagaaggcgttgcgtattccacaaaacgatgaccacattcgttcattgaacttgtcaaacacggcagccatcgttatctatgaaacgttgcgtcaacaagggttcccaaacctagacttgacccacgaatacgactacgacaagttgaagtaaaaataaatgagcgtttattcacttaagaaaggagattaatatggcggcgacagcaaaaaagcgtccgactaccaagcgtaaaacaacgcccaaaaagtcgacgtctgccaaaaagaaaaaagcagcgcaacagaactggtggcttgaacgtggcccacaattgattggactatttgcgacgattatgacggttatcgccatcgctaaggttggattagttggaaagtttttggctaatattattcgccttgtagtaggtggttcttatcagttcttcttgcttgtgctattaattccactcctggtggtggttgcttacgggcaatggccaaagcgctttaagtggcaacaatacgttggtttcaccctcttttatttgggtgtcatgttggttggatcaattttgctctttgataagatgaacgtccatgaggcttacgcacaaaccattcaaacgctaatcaatcaagacatgaacaataaggcggtcacaaccccggttggtggtggcctcattggggcgttgatgtacagcggtacttatatggcgatggctgattttggatcatggctggtagcagtcattctattgattgctggaccggtcatgttcttcaatttgccaatccgcgacgtgtttgacaacttctttaatttggcggaaggtgccggtgatttggtgcaaacgcaagcttcaacagcccatgaaaaggtgactgaatcaattgaaagcttccgtgtccgtcaaaagtcagcgatgcaagagttctttaacgaagatccgtttgcatcagaagcagaacgcgctgcgcagatgatggatggcttgcccgatgcctctgcgtcaaacgatgcaccaatcacatcaaagaaggctaagacaccaacggcagctgtggaggctgaacctgaagtcgatgcaactgccactgaatttgtgatgccagaaattgtggcaccagcaccattcaagccagaagcgccagttgatgaagcaacgtttgcggcggctgagccagtgacgaatgagttcacgccacttccaagcgaagatgaagcgcccgttgaaatgacgtatgatccaagctttaatccggatgccgttattcaagcgcaagatgctgcaattgaaccggttgtttatggtgaagacctaccagatgatgagctattgcctggtcaagatgtgccattgacgcacgctgatattcttggccacaatgatgcgcaaacgtcaccaaagacaacggcgcaccaatcaaatgttggtcacgttgagccatcaacgatttcagaaccaacggctgacgtcgatgcgtctggtttgggtacgttgattgacgacaaggattacattttgccaaccactgacttgttgcaacacattggttcgactgaccagtcagcagagcgtgatgcgttgaacgacaaggcgcgtatcttgcatgaaacgttgaagagttttaacatcaacgcgacggttgaaaaggtggttctcggtccaacggttacacaatacgaaattaagccagccgttggggtgaaggtgtcaaagattcaaaaccttgccgatgacttggcgttggccttggctgccaagtcattgcgtattgaagcacctatccctggtaaaaatgttgtcggaatcgaagttgccaatgatcaacaagcaacggttgggttccgtgacatggttgaagaggctggtatcgataccaccaagcctttggttgtcccaattggtcgtggtgtgacgagtggcgtcgtgaaacttgatttgacgaagatgccacacttgttgattgccggttcaactggttcaggtaagtcagttgccattaacggtattttggcttcaatcttgttgcaagctaagccatcacaagttcgtttgatgctggttgatccaaagaaggtggagttgtcagtttataacgacattccacacttgattacaccggttatttcagaccctaagaaggcatcgcttggcttgaagaaggttgtttccgagatggatcgccgtttcaagttgctggctgatgaaggggtacgtaacattgacggttacaaccgcttagttgaaaagcgcaatgcagcggacccaagtacggtccttcaaaagatgccatacttggttgtcattatcgacgagttggctgacttgatgatgacgtctgccgtttcaggcgacgttgaaaactctattgtgcgtattgcgcagttgggtcgtgccgctggtatccacatgattgtcgcaacacagcgtccgtcagttgatatcattactggtttgattaaggcaaacgtgccatcacgtatggcgtttgccgtttcatctggtgttgattcacgtacgattttggacagtaacggtgccgaaaagctattgggtcgtggtgatatgctgtttgcgccaattggttcaaacggtccacaacgtgttcaaggagccttcctgactgacgaagacgttgagtcattgacggactttatcaagaaccaaggtgaagcccaatatgataagagcatggaagtttctgatgaagaagtgaacgcgattgataatcctggctcagaaggtgatgaactagatgaacgttgggatgacgtgcttgaattcatcttgcgcgctggtggtgcttcaacatcatcaattcaacgccactttggtatgggctataaccgtgccggtcgtatcatggacgcactaacggaccgtggtttgattggtgaacaaaacgggtctaagccacgtgagttgaagtttacacccgaaatgcttgaccgtttccgccgtgaagcactaaaataacgcatacgattaaatgagatggaggccgtcagatgattcgttatgatttaacaaatccagcaacggacgtcgaattggtagcaatgtaccgcgccgattttgatgtcgatgttggtcgtctatacacgtatgtgccagaactcaagggattccaattgcactacgaccacgatgttgtgttgtcaccagcagagatgcgtgatgatgctgacgttcgtttctacttgcaagtccatggtcaaaaccctactggacgcgcacgtatggcaaatattgatttccaacttgtgcaacgagatgaaattaactgggcataatgtctaattaaagtcgcattcctttttatgggtgcgactttttctatgcagtctgtgacgatattttcctaacaaatgaataaagttaatacaattattcatatggcttgggtacaatggtattaacatgtcagacaaatagggagtaacttacatgattgaattgaaaaacctgaacaagcggtttggcgacaagctagcagttcaggatatgaatatggtcatcaagcctggtgaagtgatggggctgatcggccaaaatggtgcgggtaaaacaaccacgttccgtatggtcttggattttatcgaacctacgagtggtgaaattacttgggatgggcacaagattacgtcggctgataaacagcgcatcggctttttgcctgaagagcgtgggctgtaccaaaagctaaccattgaagaacaagtgatgtactttgctgagttgcacggcatgaagcgtgctgatgcgaaggcgtcattgcaagattgggtgaagcgcttggatgtcgtgggtaagacgactgataaagtgcaaaagctttctaagggtaacgcacaaaaggttcagttgatttcaacggttatcttccacccggaatttttgattttggacgagccgttcaccggacttgatccagtgaacacggaattgatgatgaatgaaatcaagcgtttgaagcaagatggcgcgatgattattttcagttctcacaatatgtcgggtgttgaaaagctgtctgaccacctgacaatgttgcgtcacggtgaaacggttttgagtggtgccacgactgagattcgtgaatcattcggtcgtaccgagatttatattgagtcaccggtagcagacgcagatttgttggccattgatggcgtcctgtccgttgaaccacaaggcattggtcgccaagtacgtttgacgaacgccgaggttggtcgccaagtctttagtacagttgcacaagacggttatgtaccagtgtttgcgcaaactgcgccaacgcttgatgagattttccgtcgtgaagtacaaggaggtggcgtaaatgactagtcgccaattattcttagtagcacgccaaacctacttaacacgtattaagtcattcggatactgggcgttggtcttggcgccggtattgattgttggtgtcatcgcaggaatcactttcatcattacggccacgcaaagtcacaagacgccagttgtcggggtggtgaaccaaccagcgctaacgacgtacttgaaaaagacagatggttttgacgctaaggtgaagtcggttgcaactgaaaagcaagccaaagcagacttacgcaaaggtaagctagacgcgtatctgaaggagactggtgagacgaagttccaattggttgcctcagcagacggtgaatcagtttcagaaacgaagctgaaggccaacttgacgagtttttcaatgctgaacacggccgctgaaattaacttgtcaggtgaagatttgcaaaagttgatgacgccaccggttttgaagacgacaacgcaaagcgacaaaggacaatcagccggtggagcggtggccaattcagccaatacggctttggcatcggccattggtatcttgattttcgtgttcttgacgtcatacatcagtatgattgcgcaagagattgccaatgagaagtcatcacgtatcatggaaattttgttggctgcgacatcaccagcggtacaattcttcggtaagttgagcggtattgctggcttggcgttgacgcatgggttgctgtatgtaattgctgggttgctggttaacgtctttgcgccacactacaagtacttgaagatgattaaggaactattggcgggagttgatgccggctttgccattatgacgttgctaattgcattggttgccatctttatgtacatggtcctaacggcgattgttgcggcaatggtaaatgacttgagccaagtgcaacaagcggtggcaccaatcacctacttggcaatgattggttatgtgctaacgtttacgttgtcaggtcaaccaaacaacacattcttgaacatcttgtcatacgtgccattcatttcacaaacgctgatgccggcccgtctagggttgcaatatgcgacgatgggggatgcggcaattgcattggtgcttgaggtgattgtgttggtattcatcagcatgttcggcttgcgtgtctacaagcgtaacgtgttgacgtacaacgacggtaatatcacgaaggctgctttggctagtctgaagggcttgttcgttaaaacaaaagactaaacaaaaaacgtcgatgactgattatggtcatcgacgttttttcgtgagcagattattgcttcaattgctcttcatccttcttacccaagaaacgatccttttgatcatccttgacttcgggcataacgaacaagtcatcaaattgcttgctcaattcatcagtacgctttgtttgcaatggcatttggctttcccccatcaaatattcttgccaatagtataccacgattacccaggggcttgtcgtctaaataaattcatttttttgccgtcagaaaggcgtcacttttgtttatgatgaaggggcaaaagtgatttcatgggggtaggaaaaatgcagattcacgttgcaaaaacaggaaatgatcatcacgacgggacggcagagcggccattgttgacgattaatcacgctgcgcaaattgcgcaaccgggcgacacagtcattgttcacgagggggaataccgtgaatgggtgaatccaaagaacgccgggttaagcgaccgacgccgcattgtttaccaagcagcgccacgcgaaaaggtagttatcaagggctcagaagtggttactgagtgggaagagattgctggttcggtctataaggcaattgtggataacaaggtatttggcgagttcaatccgtttgacgatgagctaaatggggattggctcatttcaaacctaaatcgtaagacgcacacggcagacatttatattgatggggtgtcgatgtacgaagcgcaatcattggctgaggttgatgcaggtgaagagcgtaatcatgtacatgattttatgacggatgaggaaattgcagaaccgtacccagctcgtaccaagtacaagtggtttgctgaagtgacggatgatgtgacgacaatttatgctaattttcatgatgttaagccgtcagagcatttgattgaaatgaacgtgcgcccatatgtgttctatccaagtcaaattggtcgtaactacatcacggtgcgtggctttgaaatggcgcaagcagcaacaccttggacgccacctactgctgagcaaccaggcttgattggtgcgcactggagtaagggttggattatcgagaacaatcgtattcacgacgctaagactagtggtatttcactaggtaaggaacgcgcatcaggcgataactactacacgcatcgtcgtgacaagccgggctaccaatatcaattggaaacggtgtttgaggcgataaacaatcatggttggcgcaaagagacgattgggtcacacgtcgtccgaaacaatgagatttatgactgtggtcaaaatggtatcgttggtcacttgggttgtgttttctcaacgattgcggataaccatatctacaacattggcttgaagcgtgaataccatggctgggaagttgctggcattaagttgcacgcggcgattgatgtgcaactcacacacaaccacatccacaatacggttttgggaacatggttggattggcaaacccaaggtacgcgcattaaccgtaacgtttatcaccacaacaatcgtgacttcttcgttgaagtgagccacggaccattcatggttgatcacaatgttttcggttctgaaaatgcggtcgatgaatttgcccaaggtggcgcgttcgtcaataacttgattgctggtgcgatgaagcgtcaaaaggtgcttaaccgaacaacgccatatcacacgccgcactcaactcagattgctggctatgcttgcgtttatggtggggatgaccgtttttacaacaacgtctttatcggcacgccaaacaaggcgtgggaagtgcaaggaacggcacagttcgcggaagcgccaacaacgcttgaagcgtacattgatgcggtgcacatgacgcgaccaaccgatattgagcaattcgaaacggttgaacaaccaatgtatgtgtcacataacgtttatttgaacggtgcccgtgcaaccactgcggaaaagacaaacgtgattgatgaaatgaacccacactttgatgtggtgaagcaaggcgaagcgtattacctagaattgttggtaccagagtcagtgacgaattttgtcgcgccaacccagacatcagaaacgttgggcaaggtacgcttggttgatacggagtttgaacaacctgatggatcggactatgtcttgaatgaagatttggttggtgacaaaatcgaacgtgaattagccggaccagttggtagtttggtcgtcggtgaaaaccgtattcgcatttggtaataatgagaacgttttcaacttcataaataattcaaaaacgaaccgtaatatacaacttcggaagcaattatttatttaaaggggaaagaacagatgaagttcgcacaacaagcatcacttgcgattgcaggtacggtatcaggattgtggttgatggccgaagagggattggctgcaacgacagcaacaacaatggcaccatcttcaaccgagacagtcgaagtgattgctggattgttgatgacgtcactagccgtaatgatttacgtctacaagacaaagtaaacccttaagccactaggaagtgagagatttcctagtggctttttttgcgcagtttttcaaccaatctccggggttaaattaaaccgaatttcggcgtataatgaagtaaatactatttgaaaggaaaagcgaatggcgtcagaacatattgaacaaaaacttgcgctgttaccagatttgcccggctcataccaaatgaaggatgtgaacggcaaaatcatttatgtcggtaaagccaagaacctaaaaaaccgtgtgcgttcttactttaaaagtgaacacaccggtaagacagcccagctggttgagaatatcgcggactttgatttcatcgtcacgagttccgaaaaggaatcattgttgcttgaaatcacgttgattcaaaaataccagccgtactataacattcgcttgaagcgtggaacggggtacccttacattaagattacccacgaatcagacccaaagcttgaattggccaacgacgtcaaagaagacggcgcccaatactttggcccttatccaaacgtttacgctgcgcaggaaaccttgcatttcttgcaaaaggtttatccactgcgtcgttgtaacggttaccaaggacgtccatgtttgtatgccaacatgggacaatgcttgggtccttgctatcgtaaggtgccattcacggagtacttggatcaaatcaagaagattcaacggttcttggatggggatacaaaagaagtgacgaaggtcttgcaaggtaagatggccgacgcggctgaaaagcttgagtttgagcgggccgccgatttgcgtgaccaactgaagtttattgagacaactgttgaaaagcaaaagattatctcaaaggacgggacaccacgtgacttgttcaacttctatatggacaaggggtggttatctgttcaagtcttcttcattcgccaagcacgtttgatgaaacgtgagaagcgcacctttgccatcgttgattcgcctgaagaagaattgacgagttttattttgcagttctacaaccgtaagaacgccgtgttgccaaaggaaattttggtaccagctggcgttgataagcagattatctcagaagtgttgaatgtgccagttcgtacaccgcaacgtggtgaaaagcatgacttgctcgatttggcggaaaagaatgccaaaatcgtgttggatgaaaagttccgtttgatggagatgaatgagtcgaagacgaatggagcgatgcaagaaattgccgacgcgttaggtcttgaccatattcaccgtattgaggcgtttgaccactcacacacccagggtgaaggaatggtttcagctatggttgtttttgaagatggtgtgccaaacaagaataaataccgcaagtacaagaccaagaccgttgatcacgcggacgaacgtgctgaaacgatggaagttattcgtcgtcgctatacgcgtttgctcaaggaacatgctgaaatgcctgatttgattttgatggacggtggcgttattcagttgaatgcggctcgtgaagtcattgaagatgagcttggtttggcaattccggtcgcagcgatggttaagaatgaccaacacaagactgccgacttgttgcgtgaagaaggtgaaccgcacgttaacttggatccaaagtcgcaaggattcttcctattgcaacgtattcaagatgaagtgcaccggtttgcaattacgttccaccgtcaattgcgctcgaagagttctttggggtcaaagttggatgaaattgccggggtgggaccaaagacgcgtcagaagttattgacgaagtttggttcactcaagaaggttgccaatgcatcgattgaagaactgcgcgaagtcggcgtttctgagaaggtggccaacgccattaagatttcactgcaagcaattcaacacagtgatgattaaaggtggtcaaacgaggctaagtactgtaaaatgataagcgtcaaattgcgcttatattttaagagctttaataaagaaagtgaggtcataaacgatggcgtttgtcgaccaagttaaaatttttgtaaaggccggtaagggtggcgatggagccgtttctttccgacacgaaaagtacatcaacatgggtggtccttttggaggtgacggtggtcacggtggatctgttgtgatggaagtggatgaaggactacgtaccttgatggatttccgttacaagcgccactttaaggccacgccaggtggtaatggtgccacaaagggaatgactggaaagtcagctgatgatttgattatcaaggtcccacaaggaacaacgattactgatgctgagacaggtcgcgtaattggtgacttgactgagcaaggtcaacgtttggttgttgcgcaaggtggacgtggtggacgcggtaacatgcgtttcgcttcatcaacaaaccctgctcctgaaattgctgaaaacggtgagccaggagaagagttggacattgcccttgaattgaaggttttggccgatgttgggttggttggtttcccatctgttggaaagtcaacgttgttgtcagttgtaacggctgctaagccaaaggttgcggcatatcactttacgacattggttcctaacttgggaatggtgcgtttggaagatggtcgtgactttgttatggctgacttgcctggattgattgagggtgcctcacaaggtgtcggtttgggaattcaattccttcgtcacgttgagcgtacgcgtgttatcttgcacatgattgatatgtcaggtatcgatccagaagaagatccatacgaaaactacgttaagatcaataacgagttggccgagtacgatccagccttgttggagcgtccacaaattatcgtgccaacgaagatggatatgccagacgccgaagagacgttggcagaattcaagaagaagttggctgctgatccagatgtcccagaagatgtcgagattatgccaatttcatcattgacgcgtcaaggtttggaaccattgatgcaacgtacagccgacttgttggatgagacgcctgcctttattcctaagggtatggagcctgatgaaaacgagactgctttgtacgagtttaccgaagaccgtacgccattcgaaatcgatcgtgatgaagatggtacttggattctttacggtgatgaaatcgaacgtttgttcaagcgtacgaacacgaactacacggaatcaatgatgcgttttgcacgtcaattgcgcttcatgggtgtcgacgaagctttgcgtgatgcaggtgctcgtggtggtgacactgttcaaattttggactttgctttcgaattcgaagagtaaaaatcaaaagtcagatgcttgcatctggctttttgtgtgaaaaggagaaaatgatggccggcaatcaaactgaacacgtcagcaatccagatcaatatgtcacgattgcggcggatgaatatacttgggaacaagtcattaaaaagtctcggtttatcgttaatatggcgcgtgtgaattccgaagaagaggcgcgcgagtttattgaccgtattaataaagagcacaataaagccacgcacaacgtctggtcatacatgctaggtgaccgtgaccaagtgcaacgttattctgatgatggtgaaccagctggaacagcgggtgtgccaatgctagaagtgttgaagaacaatgaagtgcacgacgttgctgctgttgtgacgcgttactttggtggtatcaagttgggcgccggtggtttggtgcgtgcatacgctggtacagttgcgggtggtattgcagaactcggcttagtgcaacgcattcaacgtcacaaaatgtcgttgcgcattgattataagaattatgagcctctaaagtattggctcgagcaacatgaatatgttattttggatacacaatatgatacgggtgtgacactggttgtgccggtgtctgatgaagacatggcaagtttcgaaactgatgtgacggacttgttgtcaggtcaagtgacggttgaagttggggatgttgatttgttcgaagtaccttacgaaaagcgcgtcacggcgcaaacgtcgtcgctgaagtaaaagctaagtttggcttagtttaatgttcgcgccgtataatgaaggtatgatgttttaaagggttggtgagaaatgtgaagcggggcatagttgaaattcatatattggtggcactgttcatgctaacagtgtggctgtttccgacgaatttcatgtttttaatatggaacgtctttttagcgttaatcccgtttgatttatcgctgttaatcaaaaatcgccaactaaagcgttggatgacagttgtgctaacacttgtttggttgattttctttccaaatacaatgtacatgctgacggactttagtcacttatcatcaattggaacaggtttgatgactgagacgcagttctttaactacgcgttgttggctagtggtgtgatgattggtacgttgttaggggtgtcatcggcacatatcatggcggtccgcttttttggtgaagaagccagaattgaggcactagcattttatgctgttttgtcattggtatcggcatttgggatttacctcggccgattcctgcgtctaaactcatgggatctgctgactaacggtcattcggttgtgcaacaagtattgcaagcctttaccatgcacagttttgtgtttgtgatgtcatttggtgcgttgcaactggctttgctgttgatgtaccacattctcagaaaaatgaagtaaaaaataaggtcgatgctactcgagaaattgagtaacatcgaccttttatttttagtcgtttacgtcgtcatcagtgtgacgcaagaaacgtgtattcgtaccgaagataatggcgttaaccacaatcaacgcggcactgaccatgaagataccgttgtaatcaaagtatgttgcaaccagggtaccaagcattggtccggcaaccgcaccaagtgattggaatgactgattgtaggcgaagatacgtgaggtaatttcacgtggcgttgatttcgacagcatcgtttgcacggctggcaacatcgtcgcatctgaaataccaatcatgaaacgcagaatgaccaattgccagacggcggtcacaaaaccagtcggtagcataaagatgaatgctaatgcaaaaccaatcatgatcatgcggttcgtcccaatgcggtcaccaatgcgaccaaaacgtggtgcagcaatcattgttgcaattccaggcattgccgcaaccaaaccagctaagaaagtcgtacttggtgcaccgtggttaagttcacgaacaaatagtgcgacaatcggactgattgattggttgaccatttgaataatcaacgtggtggtaaacaagacaatggtgagctttgggaacttcaacatttggaagacttccttacgagatggtgaagcgccacgctcgattggtgtgaactcttctttgaccattgtcagtgttaaggtgaaaacgagtaggaaaataataccagtaataacaaatgaaatacgatagctaaccaatgaggctagcacaccgccaagaaacggtcctaacaagtttccaccggtcacaccagtaaccaatagacccaaagcgtagccggagcgttcctttggtgtttgcgtggcaatcatggcgtttgcatttgaaatgaaaccaccaaacaatccttgcaaagcgcgcaagaaaatcaattgccaaatattctgtgctgctcccatgagcaagaacacaatcgccattcctaatgaagcacggagcaacattagcttacggcctttactgtcagcgagcttaccccaaaatggtgagacaatggccgtcatcaaaaaggtaatcgcaaaagcggcaccactgtagaacgtcaattggttcttagtgaagtgtcccaaagtgtcgacgtaaagggagagaaatggcatgacttcactgaagccaattccggtcatgaaaaccccgaaccagaggacgtacaaattacgttgccaggtagggagaccagaaagtcgtcgctgaatcatgatgacctcctcaatcgctatttattttttacaagtaactattgtacgcttatttttcggaataatcacgcggtttgacggctgttaaactgttaaccgaacgtaaaatcatattaaaactattttattcgtatctagggcttgcaatctgtcataagtcgtgtagtatattcaacaataactttttcaaaaaagacatttttgtccttgcagatttaattgctggaaaatggccagcgagtttctaccgcctacctaaagtggcgacaatccgcaaatgactcacaagagaaaaccctctttgtaagcatttgtggatcactgtatccagaaatgcttttttgttacacaaaatttggaggttctcatgtcacacttttcagccacaaataagttcgttccaatgggattgacgtttgatgacgttcaattggtaaacaacacgactaacggattatcacaaagcgatatttctttggcaacgaccctaacaccaactttgcacctcaacattcctatgttgtcagccgcgatggatacggtaaccgaagcgcgtttggcaacgcaattggctttgcttggtggtatgggtgtggttcacaagaacatgttgattgccgaccaagcagccgaggttgctaaggtcaaggcggcaacaatcgatgtcgcacgctacccacaagcagcggttgattttaacggtcgcttgttggtcgctggtgcggttggtgtgacgtcagatacagtgacgcgtgttggtgccttggttgaagctggcgttgatgcaatcgtgcttgattcggcccatggtcattcagaaggggtgttgcgtaaggttagcgaagtacgtgctgccttcccagagttgaacatcattgctggaaatattgcgacgaaggctggcgctgctgccttgtacgatgcaggtgccgacgtggttaaggttggaatcggacctggttcaatttgcacgacgcgtgttgtggctggtgtgggggttccacaaatttcagccattgccgatgcagctgaagttgccaagcaatacggcaaggccatcattgctgacggtggtatcaaggatgctggtgatgttgtaaaggcgttggcttcgggtggaaacgcagtgatgcttggatcaatgcttgctggtaccttggaagcacctggggaagtctttactgatgaacaaacaggtcaccaatacaagtcgtaccgtggtatgggatcaattgcagcgatggaaaacggttcaaaggatcgttatttccaaggtgaagttaatgaagccaacaagatggtgccagagggtatcgaagcacgtacggcgtacaagggtgcgttgacggatgtcttgaacaatgtattggttggggttcgacgtggcatggtaaatgctggtgcaacgacaattgatgagatggtgaaccaaggtcacttggctaatatgaagcaagcggttgattacacgcgtttgccacaagtaccacgtatcgttgtcgcacaagcctaggggagagtttaaacatgatggaaacagaagtagctggattgagtttggatcaagtattgttggtaccgagtgaatcaaacgttttgccaaacgccgtgtctttggtgacgaatttatcagctgatgtgcaagaggcattgccggtgattggggcaccagcgatgacggatttggggatggcacaagcattcgctgaaaacggtgcactggcagtcttgccagctgggggaacgcaattacaagatgtgcaaacaatggtcgctgatgatgaggctacccttgttggggtcgaagtcttgaatgaagttgatgcatttgagacggcagttatgctccatgcagctggggcgaagttgattgattttgtattggatgacaaccttgaccaagccatcgagttgttgcgtttgttggcgcaacaagtaccgccattgacgattatggctggtccagttgctgatgctgagacggcccgtcgattgtttgaaacgggcattgatttggttaaggtagccccattgcctggtcaaccggtatatacggtaacgacaacgatggcagttgctgaagttgcgagcgaatttgatgccggcgttgttttgggtgctggtattcgctactcaggtgacatcgtaaaggcgttggctgctggtgcggtagctgttatggtcgacaccgatattatcggtgacacacctgcggatgatttgttccaaattgctggtgggctccgttcaggcatgggctacactggttcagcaaccatcgatgatttgcgtcttaatgcgcaatttgtccaaattacagcggctggtttggctgaaagtcacccacatgacgtggaattgacaaagtcagcaccgaactacgccaagcaatagatttaaaccgaaagtgcggcttgccgcacttttcttgtatacataggggtaatgaaatgacagtaacagcagattggcatattacgaatgccaaagtacttgatgtttttaatcaaaaatttgttgagacggatctttgggtaactggtgacaaaattgttttcttgggtacgccgactgatggcgtcgcaagccaaacgtatgatgcgcaaggtcagtacgtgattccaggcttgattgatgcgcacatgcacgttgaaagtacgacgttagcaccgacaaccttggcaagtgttttcatggaccatggggttacccgcgctttcattgatccacatgaaattgcgagtgtggctggtgcaccagctatccaatatatgttggatgaagctggccggacgccgttccattatcatgtgatgttgccatcgtcagtaccggccacgaacttcgagcgcactggggcagcgctgcatgcggctgacttgaagccgttttacgagcatcccgacgtcggtgggttggctgaagtgatggactatccagcggtcgcaaatgccgatccagatatgatgcaaaagattgctgatgcattggctgcacacaaaacggttgatggtcatggagcagggctaacccctgagcaaattgcggattaccgtaatgttggcattgataccgatcacgaagcggttaatgcccaggaagctgctgaacgtgcagcgcttggcatgcacatcttgattcgcgaagggacggttgaacaagatgaattggcaatcttgccagccatcaatgcccaaaatcaacgtcaattctcatttgcaacttatgataagacggcagtggatattgcagaaaatggtggtgtcgaccatagtgtacgtgttgcgatgaacgcggggatggctactgaattggcgttgacaatggcaacgttgaatgcggccgaagcacatcacctcgctaatgttggtgcgttaacggctgggtatgtggctgatttggttgtggtgggtgatttaaagacgttgaaaccaacacgtacgatggtcagcggtgaatggatcgatgagcacgagccggtgcaaccacgcccattcgccacgaacttgatgaatgtttctttgactaaggctgatttggcattgccattgaagacgggccgtgcgcacgttattgacgtaaagcctttccacattgataccgaacacagcattgtcgatgtcacaatgaatgaagaccatgaatttatgccaacggctgaatttgccaagattacggttgcggaacgttaccatgatttgggtaatggcgttggtatcattcgcgggttgggcattcgggaaggcgccgttggcacaactttctcaaatgattcgcacaatgtggtgattgctggtgccagtgatgaagcgattgtgcaggcggccaatgcgctccgcgaaattggtggcggtatggttgttgtggatggacaaggcgacgttacagcactgccacttgaaattggtgggttgatgaccacggcatcagttgaaacgacagttgctaagacccgtgagttgcatgctaagatttcgcaactatgcaatgtcgactttgatgtcttccaaacgttgtcgtttatggcattgccagttattccaagtttgaagattacggatcaaggcctgtttgattttgacacatggtcattcattggtattgatgctgaatagaaaatgatggtaaacaaaaatggaccgagtcacgaagacttggtccatttttgctgtaggtttataagagatatgttaattgagtagattcgcttgggaaagcaaaatcaatcgccatgtgggtgacgaatcaacttgcagaattacatgggtttgtaattcggttaacatcaagtcgatatacttataatagctttgagttgtgaacgaattgtgaaagaaaaatagaaattatcgatttgactaactaaaagtgctttcggtgtatcgcatgtgatacaaaaggagccagatgcttgattttgtatcttcctgttcgggaaaacttaatttctggtacaatatgaattaagtaaatgaacagggagaagatagatgtacgagtatttgaatggtgttattactgatattgcaccaaattacatcgttgtggaagttggtggcgttggctatcgcgtcttagttgccaatccatacgcttttccattgaatgaattagaacgcgtttacgttgagcaaattattcgtgaaaacgagcaatctttgtatggctttattacggctgatgaaaagttgctgttccaaaagctgctaaacgtgtctgggattggtccgaagtcagctttggccattttggcgaatgctgatcacagtgggctagtgagcgcgattgctaataacgatgtgaacttcttgattaagttccctggtattggtaaaaagacagcgcaacaaatcattctggatttgcaaaacaagcttggtgatttgccgtttaataatgacactgatcttggtttgattttgccaacgcaaccagctaatgatgataacccagagttgacggatgctttgttggcacttgaagcgcttggatatgcgaagaaagatgttaataaggttgaaaaggcactggctaaggaagccccaatggatacggctgcgtatgtcagtgctggtttgaagttactccaataataagccgaaaggaggctgttagatggctgacgatattttacgtgacacggcggctgatttcggtgaggaattgattgaaaagtcacttcgcccatcaacgttgagtcaatacatcggtcaagaaccgctgaaggcccgcttgcaagtttatattcaagcggcccgtcaacgtgaagaaccccttgaccacgttttgctgtatggaccacctggactaggtaagacgacgctggcaatggtgattgctaatgaaatgggcgttggtttgcgtacgacgtcagggccagcgattgaaaagtcgggcgatttgttggctttgctaaatgaattgcaaccgggtgacgtgttgtttattgatgaaattcaccgtatgcctaagacagttgaggaaatgctttattcagcgatggaagacttctacgttgatattatcgctggtgaaggcccaactgcccgaccaattcacttcccgttgccaccattcacattgattggtgcaacaacgcgtgccggtatgttgtcacaaccgttgcgcgatcgctttggtattgtcgaacacatggcgtattacacaacagctgagttagcagagattattcaacgttcagctgacatttttaatacaacgattaaagagtcgggtgcgattgaattggctcgccgatcacgtggaacgccacgtgtcgcaaatcgtctacttcgtcgtgtgcgcgacttcgcgatggtgaagcagcgcgatgacatcgatgatgcgatggttaacttctcattggatttgttgaaggttgatagtgccggactagatgaagttgaccacaagattttgcgcacaatgattgaatactatcaaggtggcccggtgggtgtgaataccatcgcagctaatattggtgaagaagttgatacgattgaatcaatgtatgagccatatttgctacaaattggtttcttgcagcgtacaccgcgcggacgtgtggtgacgcaagcagcgtatgaacacttaggactaccatttgttgagaagaagggttaattgagatgacagaacaacactatacacttgaagattttgactatgatttgccacatgaattgattgcacaaacgccattgaagcaacgcgatggctcacgtttgttggaattgaatgcagaaacgggtgaagtacacgatcgacacttctatgatattttggattacctaaatcctggcgatgcattggttatgaataactcacgcgtcttgccagcacgcctttatggtgagcgtccaggaactggtggtcacgtagaagtcttgttgctgcgtcaagatcatggtgatgtttgggaaacgttggtaaagccagctaagaagtacccagtgggtcaagaaatcgtctttggggatggtgcattgaaggcagtcgtcactgaagagcttgaacacggtggtcgtatgattgagtttaagtacgatggtatcttcttggagattttggaatcacttggtgaaatgccattgccaccatatattaaagagaagctagatgataaggaacgttatcaaacggtttactcaaaggttaatggatcagctgcagcgccaacggctggattgcactggacaccagagctattgcaaaaggctgctgataagggtgttaagctagttgaattgacgttgcacgttggtctaggaacgttccgtccggttgaagaagagaacattgaggatcacaagatgcactcagagttctaccaattgtcagctgaggcggcacaaacattgaatgatgtgaaggccaatggtggtcgtatcgtggcaacgggtacaacatcaatccgtacccttgagacaattggctcaaagtttaatggtgaactgcgagaagactcaggttggacggatatcttcattaagcctggttacaagtggacggttgttgatgcgttcattacaaacttccacttgccaaagtcaactttggtgatgttggttgcggcgtttactggacgtgaaaacatcttgaatgcttatcaacacgctatttctgagggttatcgcttctttagttttggggatgcgatgtacgttcacaagtagaaaataaaatgaattcaaacttcttttaaaaaaggggttgacgattcataaatggatgtgtattatatattatgttgttgcggcaacgaagttataaaaagcattcatgcggatgtagtacaatggctagtgctccagccttccaagctgggaatgcgggttcgattcccgtcgtccgctttgtagatcattgaaaactgaatatcgtttcgatgaaacaaatgtgtagggtcatcaagctaagcttgatgcaaaaacatttgcgaagtcaattcgctagtaaattcgtttaacttctgttaaacaacaaaaattgagttaaggaattaagaaaatatggctacacaagcacaatcacagggtcgctatgccgtagttaacacgttgctagacacaacagatgtgacgttgattgactcactatcaggacgtcagggtgacaatgggcgtatcgtttactttgctatcaaggacggcaacttgccacataacttagacggacaaaacgttgttcttacagcaaaggattcagtaggtaaggtcaagcaaatttctggggttcacgacatgatttcagccacgggaggtttgttttcaatgctaatcccaggagagatgtaccaatcagctggtgacattgaagaggcttatataagtgttcaagacggcgctggtacggttatcagctcaatcccagtaacattcacggtgttggctaacaatattttgttcacagctaacgcttcaaaggactacatcgattcagtacaaaaggctgttgatgaagcaaactcacgtatcagtggtttgaatgacaacatcaaggcacaacaacttgcttatgaaacgttgaagacgtcagttgagaatctggcagggcaaattaattccaagcaagtagctatgctgaacgttgaaaatcacttcactgaaacagctacgttcgacaagggtgttacagcaagcaatgtaacttctaacggtggggttacggcaaagacaatcagcacgcctaacttcaagtcagatggaacttctatccaacaatcaagggacggaaagacttggcacaacttggcggacgatgatggtgttgtacacaactctggaaatgagaccatctcaggagataagtcactcacaggcaacacaacattggctaatgttaaaacgtcaagtatcaagaccggtactgttactgcaaacgggttaagaatggacttccgagagtttgcaaccggcgtagaggtttggtttacgggtaccttcacaggtgatacttcgtattcatggcacgacttgggtcaaatgcctagcaacataacaaagcctttcagtttcgtaacggcagttatgggcggccgtagtgggattggtggagtttctactcaaacagacctacttcttatggtacacattaataacgcaggacagattcagtatcaaatgcgccaaggtgttgagaataacaactcagactacaaaggtattgttttatatgttgagggttctgccagctactttaagtaataaaagaaaggcgtatgatatgggattttttccacatgacttagcgggttggctcactgttctggcaaccctaagtgccgcaatgtggttcgtaatcaagatgacctttgtcaaatcaatcgacagcttgaataagacaattgccggtttgcaggaggctttgaaaggctatgattcacggattgatgaccacgagaagcgtatatccataatcgaagattggagggaacatcacgatgacaatgaataacttaataacccttgtagaagcgttgtgggatagtggaatcttgccagcgcttttaattttgctcattgggtggctatcatcacgatttgcccgcaataagaggatcacagccttgcttggtattgcagaagaagtggttaagtggtctgaggtgacctttgacggtggccaaacgcaaaaggctcaagccatcaagatgattacagattatcttatgaaggctgacaaggctcatctgttcactgctaagcagattgatgacgcgatcgaatgggccgtcaaagagatgaagaaaggaacgattgaatgaaaacagtaaagattctgggtgataccctaaacaaggttgccgatacatcgactgtctttgatttccgactttggaacgaaggccaggcacaagatgttgctggtaaggctgtgtcgttcgtgattgctaatgattctggctatctattcgatgcaccagctgtggttgacggtaacgtgatttcgttggatttctcaaatgaactattaaagcaattgacgcctgacacgtaccatatggaagtgtctgttaccaataagaatggcgatgttgagttatacccatcagagggcacaatcgacttcacgatgggtaagaaccttcatggcacacaggggaagctagtcccgcaaataacgtttgatgcagttttagcatctgttgatgaaaagattgctgaatacaccaagataattgcaaagggagataagggagacacgggtgctaagggtgaccaaggcccacaaggacctaagggtgacacaggcccacaaggcccacaaggaccccaaggtattcaaggacctactggtgcgctgccaacacgaactccaacttttacagattttaatgatgttgctcaaaacatggttaaatactcaggttcatgggttatcggtacacaacaaattgctaactcaccgctacaaaattattatacggcgacaattacaccggcatttggagacggcggcagtggatatatcgaattggtaccttttgcttttggttcagcaagcaagtatatagcggtagttgggtcgcagaaactatcagcttggaaatcattttcttttgatgatagcgttgtacacaatgctggcaatgaaacgattgcaggggataagacgttcactggaaaagtatatggtagtaattttgtagaaactggattgccaatgattgcaaaaacaaccaaggatttcaatgggcttacgttcagcttcacaagagttggtagtacggtgtatgttaccaccgcaacgacaactgttaccacagcaattccagttggttggtatgatggaatcgttccgtctggttatctaccggtagaaggagttgaattggtgtatttgcaaaaaccaagtgctggtgggtatgtgtctgcgtcatcatctggacgcggttacttcaatgcgacacttgttgttggagacaagccacgtattgttgcatgctatccgacagtagacgcatggcctaataattagcaacctaaacgatttcgtcttaaagaaaggaaaataaaatgacagtaacagtaagttttgacacaccacaaattcaagtaaataacagcagtacaggtattcaactattacaggtaatcttgccttattcaatccgtaactcagaagacttcagccaatacttgggcggtcagatgacgttaggacaatccgatggaatcaagttgactgacaacacgaaggactgggaacgtcttggcttggctaagattaagaacatggtggctgacgcagaaatctatgtgctagacccaatcgttgaatttccagcacgctcagaagctccagcaagttcagcagataattcagtagcaagctcagaagctactgtagaaccttcagctccagcaagctcagaagaagcaccagtaagttcagcatctacagtagcaagttcagcagaagaagcaccagtaagttcagcatctatggtaacaagttcagcagaatctcagataacaacaacaccttcagaatcaacaacggaggaataaactcatatgaataaattgctaaaaagcgctttggcttcggctggggcgcttttaattatgggatcagtaccatcaatacatgctgccaaaggcgaccaaggtgttgattggtcgatctaccaaggttcacaaggtaagtttggatatggtcaggataagttcgcaatcgcgcaaattggtggttatcacgggtatatctacgatcaatctacttatgccacgcaagtccaatacgcaattgctcagggcaagcgcgctcccacgtatatgtggtggcaagatattacagattatgcaactgctgataaggtattggactacttcctgccaaaggtacagacgccaaatggttcaatcgttgcacttgacgttgagagtggcggacagaacactgacgtaatcatgcacgccttgcaacgtattaaggacgctggatatacgcctatggtctatggttacaagaactacttgcaagattcaactgacttgcaacgtatcgctaattcatacgagctttggcttgctgaatatccaaactatgaagtgacaccagagcctaattacaactattttccatcgtttgataacgttggactgtttcaattcacatcgacttatgttgccggtgggttggacggtaacgttgacttgagcggtgttactgataatggatacaagaacggtaatcctagcaagccaaacacggacacgccagctgtggttgccggtaaggaagccgacaacactccaaagtcagatattgcagcgggaatgaccgtaaaggttaacttcagcgcaacacactatgcgactggtgaagctattcctgagtttgttaagggtgaaccacacaaggtgttagaagttgatggcgaccgtgtgttgcttgatgacatcttttcttgggtatcaaagaagaacgtcgaaatcttggacgctaacacgcaagatgactcggcagagtttaacggtgtattcgtactagatagctggcaatacgagttgggtggtgtgtacgttcgaaacaatgacatgtcaattcctgtggcagactaccacaacgatatgccggctgtatcagtaacgttgaccgaccgtcatggtaacccattggcggaccaaaacggccttggcaacaacggagttccggaatacttcactttgaatggacgatacaaggtattgcaacgtgttggatcatcaattgaagtagagatgaatggtgaggcggtctggttgaagtctgcattcgctaactagttttaaattggaccaacctgtgacattgaaacagatacgcaagttggcccatatataaattaagcccgctggatttggatgaacttccttgtctagcgggcttttctttattaaaattgacattcaatatggtgccgcatataatgaaggcatatcaagtccccgggcaattatgttcgggctttttttatagtaaagttggaattaaaaatgaatatacaagatgaagatcaaaaacttgtaaatgtttttagtgatcgaaagatgacaatcgattctgaaaatgcaagtatctacattaaaaatatcggatactataagttaaaagaatacgcaaagccatttgtaagggatggcctatatgatggactactattcagcagtgtgttaaaacgatatttttttgataaaaacctaagaatacatttattacatattattgaaatgattgaactagcctttaaaaacagtcttgccgagctaataggtaatgactctggcccatttggatatttggactttttagtttgggctgatcaaggacgttatacctctgagtatattattggagaacaatctttgataaaaaatacaattttgaaaatgattaaaaatatgagtgaatattcaaatccagaatattttgacgaaaaaaatttcactttaaaagataataaatataataaagtagaaaatggttctcaacataagaagtatcctaccgtttggctagcatttgatttattgtcatttggacaattacatcatatttaccaacttttaccgttggaaagtaaaaataaaattgctaaaaattttaattgtggtagttctgaattaaattcatggattggggcaatggttttagttagaaacgtttgtgcacacagttctaatttaattgatattgaatttaaaactttgccaaaatctaaagtcgaatggagagaatatttacatgttcacgaacgaaaaaatggtaaaactgagataactaataaattagccagcattattattccgatagtttatttggctcataatatagatcaaaattatggctttggagacatctataaagatattcaaaacgccataaagcctgtaagaaaaaacggtgaaaatcaagcgcaagcattaggctttagtagcaagaaaaaaatgattaagttcttttccacttattttcaataataaccttagttgatttacttgaaaaaagcccgctgtacttggattaacttcctcgtctggcgggctttttattgtacaataattaggtgagaaatgtcgggccataccctgcaaactaaaattggatccagattagtttgcgccactaaatacgaggcttaatatttgcgccatatttgcgccagtgaactctcaaactactggtgtataagcatttacacattcccacgtacaatgaaccgtttgtggccataagttaatataaacattaataaaccgctgaaaacagtcgttataactgttttcagcggttttttatagtcgtaagttgttttggttgtttgtttttcttctttcgacgacctataacgaatagtgctagcagccagaaccaggggcgtagccataatgggcggttattattattatccatattgcaaatcctcctatattgtttagcgtactctgaatatgaccatcgcgcagacggaaatatgggggtataatagaaaaatcgaaaagtatggggcacatgctttcaaattttagttaggggaacgtatgacagataaattgaattttgcagcgtttatgcaatctggtacaacgagcatcagtaactatttactacaacattatcgtgaccttggcatgacaaacgaggaactgcttgtttatgtacaaactaaggcaggcatcgatcgtggcgagctggaacctagcacgcaaaaaattggggacacgcttggatgggatgcgcagacagtgtttggacatcttgaggccatgcgtgccaaaggattggttaatttcgttagtatgcgtgatggcgccggccgtgttagcacgcaattggatttccaaccgttatacgacaagttggtttccgaaccgggcagtgatgccatgacggcagcgcaacgagtggccacgcaaggtcaaccggtcacgcatcaagatgatttgagtcgtgctgcgatttataatttaatcgagcaggagtttggtcgaccattaagtcaaatggagatggaaactgtcaagaattggtttgacgttgatcattttaagccagagtttatcaagtcagcggtgcaagaagccgtgcttaatgcagctttgaatctccgatatattgagacaattctagttgcatggcagaagaaaaattatcgatctgtccaggaagttcgccaagagcgtcagaaacgtacgcagtttaagcagcttaattcagatgaaaaggttaacattccgactaatgtcgatattttaaatactgattggtcacagtttaaatagcttattaatcagttaataagtgaataactatttatttaataaaaccgttaagtccgttgatttaacggtttttttgctgccgtctgcatttttatattagagaaatattaaaaaagacttgctaaaatcacattttagtcataatatgatgaaatcaatcatggaaagtaaggggaatgttaaatgaatgattcgaatttgctagttgctaaagatgtgagtgttagttttaaaattcgcggagagttcgtgacggccattaaggatgttagtttatcggtcaaaagtggtgaagtattagcccttgtcggtgaatctgggtcgggaaagtcaacgtttgcgacctcagtgattgggttgcatgacccaagccaaacgaaagttaccgggaatatacatatgggcgaacgcgaccttctggcattaacgccagacgaatggccagcgattcgcggtgccgacattggcatgatttttcaagacccgctggccgcactaaatccactggcaaaggttggtgatcaaattcgtgaggctttatcggtgcacaaggtttatcaggaatctgagtatgatggtcgagtaatcgagttgctaaatcaggttggcatcccgtatccagaacgcgtggccaaggagttcccacatcagttgtctggtggcatgcgtcaacgtgtagtgattgcgttagcgattgcgaataaaccacgcttgattatagccgatgaaccaaccacagcattggatgcaactattcaggcccaaattttggatttgctcaaggatatccaagatgaaaatggtgcgggcattattttaatcactcacgatttgagtgtcgtggctgaggtggctgatcgtgtggcggttatgtatgcggggcaaatagtcgaggatgccgaggtcgctgagttatttgcgaattcgttgcatccctacacacgatcattattacgatcgaatccgaccattgatgctgatacggatgagttgtatgtcattcaaggcaccgttccagggctgaagcatatcgattttcataaagatatgttcctacaacgaacaccgtggttgccggaagatgttcgtaatgaagttgacccccaattggaaaaggttggcccagaacattgggtgcgtggcaattcctggcgagtgtttaggtttgatgatgaggtttagggggaaagtatggcagaactattacgggtagaaaatttaaaagttcattatccaattcgaagtggtttttttaatcgtgtaacggactatgtgtacgcggctgacggtgtgagtttatcaattgaagagggtaaaacgtacggtttgattggtgagtcaggttcggggaagtcgacaattggtaaagccattgttggattggaggaaattacagccggtaagatcttttttcaaggagttgatgtgactgatgctaagagtcgatcacgcattaattacaacaaagatgtgcaaatgattttccaagattcaatgtcgtcattgaatccgcgtaagacaatctttgacattatcgctgagcccctccgtaacttttctggttacaaagaggaggcgcttaaatcagaagtgcgtcacttgcttgaaatcgttggattacccgaagaaacgatgtatcaatttccgttccaattttccggcggacaacgacaacgtatcggaattgcgcgggcggttgccacaaaacccaagttgattgttgctgatgaaccggtatccgcgcttgatttatccgttcaagcgcaggtgttgaactacatgaaggccattcaacaagaatttggcatcgcctttttgttcatttctcacgatttaggggttgtccgtcacatgaccgagaatttagccattatgaataacggccgtttggtagaggttggcacgagagatgatatttttgatcatgctcaacacttgtataccaagcgattgctcgcagccatcccagagattgatgtgccaaatcgggctgaaaaccgagcacatcgcaaggcgattgaagctgagttccaagaacataaggcagcatactacgacaaagacggtcgagcctttccactaatctcagtaagtgaaacacacgcagtagcgttaccagaaaattatttagaagcggaggacttttagcatgtggaagacaattttaagacgtttgctaatcatgattccgcaattgtttcttgtgtcagtattagttttcgtactcgcaaaggccatgcctggtgatccgttcacaggtaagtttgggccaaatacggatcccaatgaaattgcagctttgcgtcaagcggccggattgaatgacccatggactgtgcaatatgcacggtggattggaaatgcctttcatggtgattttggtcaatcattccaattgcaccaaccggttgctcgcgtaatcggtggtcgtctgggaaatacggtctggctgtcattgcttgcgttggctggtacatatttggtttcaattacgatggctttggtggccgcgcgtcatgaaaattcacgcacagaccgcttcttgttgatttataattcaatgattttctcactgccagcctacttgttctacttgttcggtatctttgtttttggatacaccttaggttggttcccaacctcgggttcagtgtctgccgaggcatctggcttcttcggaacgctgggcagtcgaatttatcacatgattttgccagcgttgattgttgcgttaatctctacaacgagtacgttctcatacctacgttctggtattttggatgaatcaaagcaagagtatgtgaagttggctcgtgcaaagggtgtcccagaaaatcgcatcttttcacgtcatatcttacgtaacgcatttttgccaattgcttcaaccatggggtacgcgattactggcattttcggtgggatgattattgcggaaaccattttctcgttccctggtgtagggtctttgttcgtgcaatctgtgctttcacgtgattatccggttgtaacggcgttagttctgtttaacggtgtgttggcggtccttggtggtttgttctcagatatcatcatgagtatcgttgacccacgtattcgaatttcttaagggggagatttttcatggaaaaagcaaagaaaaatgtgcctactctccggaatgcattaaagcgtgaattcaaaaaagatcaagtggcccagttcgccctgattttattagcgctcataacgattgcgatttttattggtgctttattcgtgccacgcgcatcgtttactgatgtgaatatcatggatcagtacttggcaccaatgactgatggtcacatttttggaactgacaatggtggtaaggatatttttgccttgctacttgtagcggcacgcaattcgctaaccatcgccttctttgtgacggtgctaattttagcgattggaactattggcggtcttgtgacggggtactttggtggtaagtttgatttgatctttatgcgttttattgatttcatgaccattttgcctgtgatgatgatcattattgtgttagtgacggttgtacctaactacaacatgtggacgctgattgttattatgacgctattggggtggttcaacacagtacgtttgattcgtgcgcgaactttggtagagaccaaccgtgattatgtgcgggcgtcaaaaacgtcgggaacttcgaatattaaaattatttttcgcgagattttcccaaatttgtcgtcattgattattgttgaagcaacattgatgtttgcaggaaatattggtttggaaactagcttgtcattcttgggattcggattgcctgcaagtacgccgtctctaggaacgttgattaattatgcgacggatccagaaacaatgacggctcgtccgtgggtttgggtacctgcagcggtcgttatcttgttgtacacgttgttgattatgttgattggacaggcattacgcagagttgctgaccaacgtcaagctgattaaattaaaataagattagaaaacttattgacttttaataaacatgggcgtaagctggttcacaacaagcagttactatttgttaatgggggatattttatgagtaaagctgtaaaatggctgctcgggctagttgttatcgcactagctgcagtggcagcattcttcgcattcgggcgcaacggtggtaaacaagccgaccaggatgatgcgaaggtgggtaagttgaatgtggcgtataacaatcctgaaaagccaattaagggtggcgatttaaagattgcggcagtttcggattcgccattccaaggatcttatatttcgcctctggccgatgatgcgttgacatcagagttgtttcagccaaccggtcaaggaacatcaggtatttttgccacggacaaacaatttaagattaatgataagggtgctgccacaattgattttgataaagatgctaaaacagccacagtcaccttgaataaaaagttgacgtggtcggatggtaaaccagtgactgcgaaagactatgaaatgacttatgaggtcttggctaacccagcatatggttcatcacgttggacggattcgttggcaaatattgagggattagaagatttccacaatggcaaaacgaatacgatttctggtttgacgtatccagatggtgagtctggtaagaaggttgtcattcacttcaaggaactcaagccaggaatgccatattcgggaaatggttattatcttgaaagtgtgaccccatatcaccaaattaaggatattgcgccagaaaaattggtatcatctaaggcaaatacaaccgaaccgctaacatggggaccgttcaaagttgataagattgtgcctggtgagtcaattcgtttgacgccaaataagtactattttggtgataagccaaaattggcttcaattacggagcaaattgtttcaacttctaaaattgctgctgcattgaacgcacacaagtatgatttgtcaattgataatgtctcatccttgtataaggaagttaaaaaggcccctggttatacgattaccggacaaaatgatttgtatgtgtcattgaagtactttaacttgggacactatgatgctgataagagtgaaaacgtcatggatcgtgatacgcctttgcaagataagaaggttcgacaagcactggggtatgcgcttaatacacaacaagttattgataagttctctaacggacttggaagtcgtgcaacctctttgattccgccggtattctcttctgtgcaagataagtctgctaagggcttcccattgaatatcaagaaggcgaagacattattggacgaagccggttggaaggtgaacagtaaaactggttaccgtgaaaaggatggcaaggagcttgatttgacgtacttggcgcgttctggtagcccaacggcggaggctgttacacaaaataacatccaacaatggaagaagattggtgtgaaggttggcttgtacggaggccgtttgcaagacttcaacacttggagcaagatcgtgcaaactggaactgataacaagtgggatatctctgatgccgcatggggattgtcatctgagccatcacaaatggatttgttctctaaggcagcgccatataacttggggcacgcaacaacgcctgaattaacgacaattttgaatgacattgattcacaaaaggcaatggatgcgtcataccgcaaagacgcctttaagaagtatcaagagtacatgaatgatgaagcttttgttattccaagttcgtttgcgattaaatacacaccggtaaacaaccgtgtgtctggatggacaatggcctatgactcatttgatttgtgggctaagattggtgtcacctcagataagttagcaacgaagtagttttaaaatgatttgaatcagactcgtgacctagtcgcgggtctatttttttaggaggggttatgcgactgttttttcgtttaaaatggtttatcaagcaggaatggcgttcctatctaatgggcattttgtcgttgattggggtagcaatttttggattaatgccacctgcgatgattggaaattttgtcaatttattggcagataatcgtttcacatgggatgcgatgtggcagattgtgggtttgattttattgacaacaatcggccagtatatcttgcggtttggctggtcgtattttatttggggaacttctgctcgcttagaacgggtgttacgtattcgattgttgtcgcattaccttgagatggataagccttttttccaacgctaccgaacaggtgatttattggcacacgcaacgaatgatgtaagtcaattacaacgagtagctggtaatggtgtgttgcaattgtttgatgctatcatcaccggcatttccgtaattttggcaatgggggtgattgtaaacccttggctgacggctattgcggtcctaccgctattaggcattacgctgattgctcagttgctaggtggcagtattcataaggcgttcacgaatgttcaggatgccttttcacggctgaataataagacgcaggaatcattaatgggtatcaaagtgttaaaaacacttggccagagtcatgaggatattgcggattttgaaactcaggtgaatcattcaattcatgtgacgcgacgtgcagcgcgattagatgcgttatttgatccggccattacagtcttaacgggtatctcttttgtcggaacaattatttatggtggttatttagttcaaactagccaactttcaatagggcatttgattacgtttgtcacctatctatctcaattggtttggccatttatgagcttgggcttcttctttaataacttgcaacggggtaatgcggcctatgatcgtattatgaatttgctagctgagcagccagataccattaatgcgacgggcgttaacagcgtgccgagtggtgatgttttcatagatatcaaatcattcacataccccaatgcgaacgagccagcgctgcgcaatgtgcgggctaaaatcaaagcgggcgaaacgttgggactagttggtagtgttggggccggtaagagcactttaattcagttgctgttacgtgagtatgatcaatataatggtgcaattacagtaggcgatgctgatattcgtgattacaacaaggatacctatttaccagcaatcgggtatgtgccacaagataattttttgttttcaaccactattttggaaaatatacggtttgctgatcctagtgtttctgaagaaaaggtccgcgaagccgcaaaatgggccgcattggatgaagatgtattggggttgccagatggatataatacccaggttggtgaacaaggtatttcgctttccggtgggcaacgacaacgtttggccattgcacgggcgttaattattgacccggaaattttaattttagatgatgcgctgtcagcagtggatgcaaagacagagaaaaacatattagcggcaatcagggcacaacgccaaggcaagacaacgattattgccacgcatcggttgagtgcgattgtcgcagcggctgaaacacttgtctttgatcatggcgcagttgttgaacgaggtaaccatgatgatttgatggcacaagcgggttggtatgctaaaacatatgccgcacaacaagttgctgaaaagatggaaagtgaggttgaatagatggataaaacggagtctgtttggacaaagaagatggggcctcgcgaacagtggcgaattgtccgggcgttgttcggctttatgcaaccatttgccaaatatttttattcggcgctactattggcgggaataatttcagtgttgaatgtggtgatgccgagagtgttacaagattttatgaacaatcatcttcacagtacgagtccacagtggcgaattttggtgatgtttgcgctcatctacctggccttgacgttagttaaagcagtgattcaattcttccaagattactggtttatgtctgctgctgagttcatggtcgaagcagtccgtatgaagctttaccgtaagttacatacacttggaatgcgatatttcgaccaaacaccagctggttcattagtgtcacgcgttacgaatgatacagcaacttttgaatcgttttggcaactctttttaactttaacaatcggtcttttttcaattgtgtcagcgtttatagcgatgtggctaactaatgtacaagttacgttggtgacgttgatattcgtgccacttttaattggtagtatttggctatatcaggtgtttgcgacaagtgcgtatcgcagtatgcgtgaaaaaatttcagcgctaaatgcccagttagcagaagcaatcacgggtatttccgtcattcaacaatttagacaggaggaccgtattgccactgaatttgatacgacgaatgaaagttattatcgctcgcgtgttcgcatggtcaagacaaattcattgttactttcaccaatggttgatttactatatggtgcagcgataatcgcggtgttgttgatgtttggttggactagtgaacgccaaatcgtggcagccggaaccgtatatgcctttttgtcatatgttggctcgttttataatccaattgatgcagcgatggactcattgtctgcttttcaagatggcatcgtggcaggaaatcgaattttagctattttggcggacgagactgtggaacccaagcagttagtaaatgcttcaaatgtggttcaagacggtaaggttgagtttaaacatgttagtttttcatacgatggtcaacagtatgttttaaaaaacattagcttcgttgctgaaccagggcagacagtggcgttagttggacacactggttcgggtaagtcgtctgccatcaacgcgatgatgcgcttttacgagtttcaatctggagatatcttaattgatgatcaagatatccggtcgcttgatttggcgattttcagacgtgaagtgggccttgtgttacaggatccgtacttgttttatggggatgttatgtcgaatatccggatgtttgatgagacgattactgatgcgcaaatcgaagcagcagcgacatttgttcatgcgaatgagtttattgacaaattaccaaatcgatatcacgaagcggttgctgaacgtggcgctggattttcatcggggcagcgacagttaatttcgtttgcacgtacaattgtgagaaatcctaaaattcttgtgttggacgaagcaacggctgatgttgatactgaaacagaaacaatcattcagtcgtctttggcggcaatgcgtcagtctagaacgacgattgtgattgcccatcgcttgtctaccattaaagatgccgatttaattttggtattagacaatggtgaaatcgttgaacggggtacccacaatgatttgttgacactaggtggtcaatatgctgatttatacaagatgcagacaggaaccatataaacaacaaaaataaaagcaaccgagaatcattaaagatttctcggttgcttttttgctaattattcatcttgtttacgttcttgcgaagaagaactagcaggtgttgaacttgagctttgagctgatgaactagcaggcgttgaagagcttgctggttcacttgatgaatcagatgcctctgatgagctttcagcaggttgtgatgaactactcattgcggaacttaccgttggcgcagaactagatgtagaacgtgaagagtatgaaggtgtggacgttgaggcaacaccgactgtcttttcattcgctacgttagctccggcaacttggtattccttctttccattaacagtcacttgcttaacagtagaagggactgtccagtccgtgccatccattgaagaatcagacataacgtaatccatcaacgcaccatagaccttcaacatgatgtattgttcgttaccagtcaaatcgtggccaacctcgtttggatcgtcataacctgtccaaacagaaatggcagcactcttagtgtatccagtgaaccaagtatccattgctgaatcagctgacatgtttgaatcttcgccataagcgactgttcctgtcttaccagcttgattataagcatcggttgcaatcatcttggcgtatgaatcgctgataaccgacttcaacatgcttgtcatcatgaaggctgtagaagacttcatagcctctgagcccttagaactaaacttcttcacggcaccactacggtcggtaatcttagaaatataagatggcttgtaataagtaccaccatttgcgaatgctgagtaggcagctgcttcttgctcagttgaaatgtcgattccaatggcgtttgaggcaaccatctccttaggatcttcgttaataccgagcttcttaaggaatgcagaagatttgtcataaccaacttcttgcaacgtttgaacggcagggatgttacgagattgtgcaatcgctgtacgcattgaaatcgtaccaaggtaacggtggtcaaagtcattcacggagatgtttgtgccaggatacttgtaggcattgtcatcaacggcgtggttcgttgaccagttcatatcttcgattgctggaccgtatgcgaccaaaggcttagctgttgatccagatgaacgcttggtgttagttgcgtggttggtaccaaatagggttgtttctttacgaccaccaatttgggcaatcacatcaccgttgcgagggtcggtaactgtcaaaccaacttgcatctcatcatcaggccaagcaacgtagttttctgtgttaacaatgttgtaggcgcggttctgtacctttggctcaagattcgtttgaatcgtcaaaccgtcagtgtcaggattgtagccaaggctcttcaattcagcattaaccgatgtgatgtacgcttggttaatcttggtcttttcttcagaattttcaagttgatcagagtgggttgataccaaaccatcatcaattggcgtcttcatatactcgttggccttggccgttgagataaccccgttttgagccattgcttcaagtacttcatcacgtcgattcttggcatccttggggttgttatatggatcgtaaccagttggtgattgtggtaaaccagccaacaatgccatttgaggcgttgacaattggttaagcgacttaccgaagtagtaatcagccgctgtcttcataccataaacaccgttacccatataaaccttgttcatataaagtgtcaaaatttgattctttgaatactgcttttcaagcttcaaagccagccaagcttcttgcgccttacgcttcaacgtttggtcactagccgctgttgagaaaacagtcaacttaatcaattgttgcgttagggtagaaccaccttgcaaaccaagtgatgaaccagtgaagttagcaaatgcagcgccgagaatacggcgaggatcaacaccgtggtgcttgtaaaaacgacgatcctcgattgaaactacggccatacgcatttcttgtggaatctcagattgcttggcaatctcacgcttttgtgagccacttgtatagaaaacgtcaccgttcttatccaagtattgggtttgtgaagtgccgacaagagcagcatttgtcactttaggtgctgatgaagcatagtaggtgaaagcaccaactccggccaatgtgccggctgcgccaagcgtcacaagcgttagcaacgtatactttgtatagcgcttccactttgaagttggctgggatgtcttcttttttgagcgtaacctttgcacgcgtgacatctcttctgtcataacaaatagttctccttatactttacgttgattaagcaattcatcaatagcggttaagtagggcgtggttgggttgattccgaggggaactaacgcaccttctgccttaataacgtcgtatggaatcgactttcgttgggtttcttgattatcccaataagtgaataatagctctgcccaaatgacgtatgtctcatttaggttggaaaagcgaataatcatgaaagcgagtccatgctgtgtaaccacttgcttcaaatgcttaatctgatgttcatggacatttttcaaaggaaatgactgcttattggtcgtttccttcgcatcgaagtcgatatattgcccattataaacaccattgtaatctgtggtagaagcctgtctaaaatatgcttccgtaattttcgcagctgaacgggcggggtagctaacgttaacaatttgaataggcgtgggctttttatgaatcacagccgtatctgttgctaggtagtacgcatttgcgtcgttcaaatcattttctaatgacatgccacgattactttgggaaacaccttttgagaccggctttgaaaacgcactcggattaaattggcgtccatttggatagttaatagccatttcgtactcctgcgtcttaaggtatcctttatattatagcaaaatgacaattattctgacaaactttcctataatgtaagtaatacgtaaagaggtgatgacgttgacagttgatggtgaattgcatcgaatttggattacagggttccgcagttatgagttgggcgtgatggggacaaaagacccaaagttgatggtaattaagtatgcattgcgtaaaattttggaaaacgcgattcaagatggtactgattggttgatcactggtggccaattaggcattgaacaatgggcgattgaagttgcgttggaattgcgggacgaagcttaccctgagttccagattgcgttgatgacgccgtttagtaaatttggtagccaatggaatgaagcaaatgccgaaaaattgacgcagctaaagtcatcagtcaattttacaagcgctgtttcgcagggtgactttgcaggacgcaatcaaatggtgacttaccagaattttatgttaacgcacactgatgaagctgttattttctttgatgaagaagcaactgaatcgaaggcgcgatatgatgatgttgccatccacgattttgcggaaaaccacgattacccggtgcgccgggtggatttggaccgtttgcaagactacgcaacggagtaccaagaaacgctttgggaagactagggcacaaacaattcacataaagtgcttttgtaactgagtttaaaacctgttaaactaataatacgaacaaaacggaggagtcctagtgatggaaaacgtgctacacaaccgcgaggaaattttgacgaaggaatttaagaagacgcgtatcggtactggatacgatatgacggatgtcgatgctttcttggatgaaatcatgtcagattatcaagcgttccaaagtaatattgatgaattgacgacacaaaacgagaagttgaaggcgcaagttgctgaattgacgaagcaagtatcagctgcggcaacggcgcctaaggcatctccagcgccagtggcaaacacaaacatggatattttgaagcgtttgtctaacttggaacgccgtgtatttggtacggcttcagaagcgccaacaccagttgctgaagaaaaggctacacaaacggctgaataagtgtataataagtaaatacgatgtattagcgggtaattgcgtatggcttatgccgtatgaggaaagtccatgctcgcactgactgcgatgtcagtagtgttcgtgctagctgaaaaaataaggctaggcagccgacttgtcggttgacggccaacgaaagacctacgggtaactatggttgagtagttgttaaagtgccacagtgacgaaccgtcaaagaaatgcgacgggtggaacgcggtaaacccctcgagcgggcaacccaaactttggtaggggcgcttgacctaacaaattgaagtgatggtcggggagacagaaatgtctgagatagatgattgccaccgggtattgaccgccaatcaatattcggtacaaaacatggcttatagctgatgcatcaggcagccgacgtccttgtggcgtcggctttctttttgcacttaaacccaggaaactgggatacataaataagaaaaaaggtgacaattatgcaaacatttaaattgatggccaccatgggagcaggacttgaagcccttgttgctcgtgagttgaaggacatgggttatgcaacccaaactgaaaatggacgcgttttcttccaaggaacggatgaagatatttaccgcactaacttgtggttgcgtgtagctgatcgtgtcaaaattgtggtgactgaatttgatgccaagactttcgaccaattgttcgagaagacgaaggcattcccatgggaagacttgttgccatatgacgctgagttcccagtaaacgggcgctcaaagaactctattttgcactctgtaccaactgtacaagcaatcacgaagaaggcgattgttaaccgtttgacggatgcctatcacgcgcgtggctacttgccagaaacgggaaaccgttttgttttggaaacggccgttgataaggatcacgtcatgattacgctggatacgacaggtgattcattgtttaagcgtggttaccgtactgaaaagggtggtgcgccactaaaggaaacgatggctgctgcgttggttaacttggctcactggtttaccgacaatccatttgttgatccaacgactggttcaggaactattgctattgaggctgcgttgattggtcgcaacattgcaccaggattgaaccgtgagttcgatattacgcaatgggactggttcgacaagaagattggtgaaacgttgaaggctcaagcacgtcaaatgattgactttgatgttgagttggatattgaaggattcgatatcgacgaaaacatgattgaaatcgcgaaggcaaacgctgaagctgctggtgttggtgatgacatcacctttaagcaattggctgctaaggattggtcaactgacaagattaatggtgtgttggttgctaacccaccatacggagaacgtttgggtgatgaggatgctgctcgccaactttacagtgagatgggtcacatctacaacaacatgccaacgtggtcaaagtacattttgacgtcagatgaaggctttgaagaagctttcggtgctaaggctactaagaagcgtaagttgtacaatggtgcattgaaggttgatttgtaccaatactggggaaagaagatccgctaatttttaaagattgaaaggggcaaacacatgagttcactacttgatggcatgaacgacaaacaggcagaagcggttatgacaacggaaggtccgttgctaattatggctggtgccggatctggtaaaacacgtgttttgacgcatcgtgtcgcccacttgattaaagatttgaatgtgatgccatggcgtattttggccatcacatttacgaataaggctgcccgtgagatgaaggaacgtattggtcaactagttgatgctgaagatgcggatgccgtttgggtctcaacgttccacgcgttggcagtgcgtattttgcgtcgcgatattgataagttgggttacaagaaggacttttcaattattgatgccggtgcgcaacgtacattgattaagcgtattttgaaggatatgaacgtggatatcgaaaagtatgatccacgttcagtgcttggtgccatttcaaacgcaaaaaacgcgatggaaaagcctgagaagtacgaagaattggctaatggcccatttgaagagattgttgcgaaggcgtacaaggagtatcaacaccaattggcgttggcgcaatcagtcgactttgatgacttgatcatgttgacgattgaattgttgcaccaagaacaagaagttttggaattctaccaagaaaagttcttgtacgtgcacgtcgatgagtatcaggacaccaacgatgcgcaatacgaattggtcacgttgttgtcagctaagcaccgtaacctggccgtagttggtgactcagaccagtctatctatggttggcgtggtgcgaacatgcaaatcatcatgaacttcaccaaggattatccagatgcgaagacagttatgttggaacaaaactaccgttcaacacaaactatcttggatgcggcgaatgcagttattgaacacaataacgagcgaattgcgaagaatctttggacggacaacggaatgggtgaaaagattacctattaccgtggtcaatctgacaaggatgaagccttgtatgtcattgcccaaattcgtgatggtgttaaaaatgatgagcgcaattaccgtgattttgccgttctttaccgtacgaatgcgcaatcacgtggaattgaagaagctttggtgaaggcgaacatcccttatacgatggtcggtggatcaaagttttatgagcgtaaggaaatccgtgatgtgttggcctacttagctttggtgacgaatccggctgataatgaaagtttcttgcgtgtcgtcaatgagccaaagcgcggtattggtaatacatcaatcgaacgtttgcgttcatttgccttacaacaaaactggccattattggatgctgctcaaaatgcggtcatgattccaggtttgacggcccgtgcagctaaccaattgacgcaatttgctgatttgattagctcgcttcgtcaacaaatgtcatttgatttgagcatcactgatttgacccgtcaaattttggaacgttctggttacgaggagcaatttaagacatccccaaccccagaaaaccaaggccgtctagaaaacttggccgaattcctgtcagtaacggaagaattcgacaaaaagtatgagccaaccgaagaaagcgtctcaaagtacgtggacttccttggtgaattggcgttggtttctgatttggatagtgtcgatgaagatgcagacaaccaagtgacgttgatgacgttgcacgctgccaagggattggaattcccagtcgtcttcttggttggtatggaagaaaacttgttcccattgtctcgtgctgcagctgatgacgcccaactagaagaagaacgtcgtttggcttatgttggtatcacgcgtgctaagcaaaagttgttcattacgaatgcttattcacgtttgctatacggacgaacgacaagtaatatcccatcacgttttattgatgagattagtccagagttgattcaacaaccagctggtcaaacgttgtcaacgactgccaatcgtgatggtgctttgccatttgcccgtcgcacacaacaagcgacggcgacgacgtttgctggtcgtcaacgccaatcatcagtggcgtcaacgccaactcgcacaacatcttccatgacaactaacaacccaggaactggcgctgataaggcggcttggacaattggggatgcggttagtcacaagaagtggggtgttggtcacgttgtgaaggtgtcaggaactggtgaagaccaagaattggacattgcgttcccagatcaaggtatcaagcgtttgctggctgcctttgcaccaatccaaaaagtcaattaacaaagaggaactgttgaatggcagatattaacacggatattaaagatctttcacaagaagacgcggcgactgagattgctgctttgcaagctgatttgaagcaatgggcacgtgaatattatgagaacgatgcaccgtcagttgaagattcagtttatgacgttgcttataaccgactagaagctttggaagctgctttcccggcgttggtgacggctgattccatcacgcaacaagttggtgggcgtgaagtgaagtcagatttgccaaaggttgcccacccggtaccaatgttgtcactgggtgacgtcttttcatttgaagagttggcagactggatggctacgacacaaaagtcattccacgaaccgttggcatacaatgcggaattaaagattgatggtttggccatcagtttggtctatgaaaatgggtcacttgtgcaagcgtcaacacgtggggatggtagcatcggtgaagatgtgaccgctaacgtccgacaaatcaagcgtatccctaagaagttgaacgaaccactgaccgttgaagtccgtggtgaagtgtacatgcctaaggctgcctttgtgacgttgaacgaggaacgcgagcgtgacggtttgccaacgtttgcaaacccacgtaatgcggcagctggttcattgcgccagttggatgccaaaatcacaaagcaacgtcagctagatgcattcttgtattttgcggttgatgctgaaaatgttttgggtgttacgacgcaagctgagctgttagctcgcatggcagaacttggtttgccaaccaatccaaccaatgcggtggtaagttcagaagcggatgttgaagcttacattacgaatcaaacagcgactcgtgatgacttggcttatggtatcgatggtattgtcgttaaggttaataacttggcttaccatgaagaacttgggaacacggtgaaggtgccacgatgggccattgcctataagttcccaccagaagaagcgttgacggttgttcgtgatattgaatggacggttggacgtactggggcggtcacgccaactgcggtgatggacccagttcaattggccggcacgacggtttcacgcgcctctctacacaatccaacataccttgaagcaaagggcattcgtatcggtgatacggtgacgttgcacaaggctggggatattattccagagattggtcaagtgattttgaagcaacgtccggcggattcaattgaatatagtatgccgttgggttgcccggcctgtggtcaggaattagtacacgttgatggtgaagttgcccttcgttgcattaacccattctgcccggcacaagtacaagaatcattgacgcactttgcatcacgtgatgccatgaacatcgatggccttggaccaaagattgtggcacagttgcttgataagaagatggttgatcaagtgtctgatttgtatcgtttgacgtttgaacaattgcttacgctggacaagtttggtgaagtgtcagcaaacaagttactaacggccattgaaaattcaaaggctaattcagttgagcgcttgttgttcggacttggtatccgtaacgttggtgcgaaggctgcgaagacgattgcggctaagtttgtcacgttggatgccattgctcatgcaacggccgaagaaatttctgaattgccaggcatgggattgattattggccacagtattgcgcaatatttcgatacagatcacgcccaagagttagttcgtgatttcgaatcacttggcgttaacacgcgttatacgcaagcggttgaagttgcaactgacacggtcttttctggtaagcgtgtggttttgactggaaagcttgagctgtttagtcgttcagatgcgactgcatggcttgaagcgcaaggtgcaacggtgagtggatcggtttctaagaagactgatttgctgattgccggtgcagatgcgggttcaaagttaacaaaagcccaagaacttggcatagagatttggtcagaatcacaattgcgtgatagtatggaaagtaaataataatcaaaaacgaaaccgctcgatgtagtgtcgagtgggtaagaggagtttttcatgatgcgtgcacttaaatggattgctgcactagttgttgtggcagttttggctgtagcattggtcttctttggtaactttttctcaaagaattcgtcatcagttaataattctggtacgacgaagacaacgagctcatcttcatcaaagaagggtgttcaggttactggacaagctgacgactcagtttacaagactgtcatcaaggacggtaagtatttgacgagcaagacccgcggtttgacggcccaacagaatgccggtaacacctttaacctggttggttttgaagatgggttgcttgacttttctaaggatcatttcagtacgtctaagtacgtgttccaagaaggtcaatatttgtctacgaaaacggctatagattggttgaatcgcaaggcgggcgataatccaacaggactaaatcctgaggataatggtaagactgacgattcacgtgcaccaatctacttgcaaacaattgaagaacaagacttcatgacgcaagacggtgataacctgaagttggctggtatcgtcatcggtatgggaatgaacacccaagacgtttatcaaaaggaaaaagatgggcctagctttacgcaagatattgataaggctgaccgcattgctcacggtaaggaaatggctgctgaagtcgttaagcgttaccgtgcaatgaaggatattcctgctgatgtcccaatctatgtggcgatgtacgcccaagccaaggatgattcattggctggtggtagcttctacagctggaacgtatctaagtcaggtgatgcacttggttcatggactgacttgaataatcaaacggtcgtgttgccaatgcaagaaggtacgacgtcatcaaagtcggttgcaagttcattgaacacgagcttcacaaactttgtcgacaaggtacaaggattcttccctaacttggcatctgtgactggtcaagccgcctaccgtgatggtacgttgcgtggtttgaatgtaacagtctcaacacagttctattcagcaaccgaaatccaaagctttgctaattacattgcgcaaattgcaccaagttacctaccaaatggggtgccagttcaaattcgaattgaagcgtcaacaggtatgcaagcttacgtgacgacggacgcaaaggataacaaatacacagttacgattctaggatcatactaattatttgaaaccagaccaatttggtctggttttttgcttgcattcataaacctaaacaagtatagtagtaaaaatatatttttttgggaggatgaatgaaatggggatgcatcaatatttatcaggtttgaatgaacttgaaatgatcacacgcgcaccggggtactttaagtatcaacctcattcagtggccgcccactcatggaaggttaccgaggctgcacagttcttgggtgacatcgaagaacaagcgggtaatgatgttaactggcgtatgctttacgaaaaggctttgaatcacgatattacggaacgttttatcggtgatattcgcacaccagttaagtatgcgtcagcaaccttgcgtcaaatgttggctgatgtggaagactcattgtcagataactttgtaaagactgagattccagttgagttgcaggaagcatacaagcgtcgtcttcacgagggtaaggatgacacgcttgaaggacgtatcttgtcggtggctgataaggttgacttgttgtatgaagcatatggcgaattacaaaagggtaacccagagcctgtgttcttggaaatttacaaggaaagcttggaaacaattttcgctttccgtgacatgccaagtgtggcttactttattcgtgaggtgctgccagagttgctggacgagcaatttccaggttcagaacaattacaacgcatctacatcggcatcttcaatgcaaagtagtcataagttgttataatgataaatagagaagtccactgttctcagtgggcttttgtgtttgttgagagaaaataactattaatgcagaaagtgagtaggcgaatatgattaatcgtgatgacagccatacctacgaggttgtgtcaaagtatgagccaactggggatcaacccacagctattgataagctggtaactggcttgaagaatggtgttaaggaacaaatcttgttgggagcaaccggaactggaaaaaccttcaccatttcaaacgtcattgcccaggccaataagccagttttggttttgtcacacaacaagaccttggcgggccaattgtatggtgagttcaaggaattcttcccaaataatgcggttgagtatttcgtgtcttactatgattactaccaacccgaagcgtatgtgccatcttctgacacgtatattgaaaaggactcatcaattaatgatgaaattgataaacttcgtaattcagcgacggcatcattgctagcgcgtaacgacaccatcgtggtggcttcagtctcatctatctttggtttgggtagtcctgaacaatataatgatcatgttattaacgttcgtgttggtgacattatcgagcgtaatgatttgatgcgtcgcttggttgatattcaattccaacgcaatgatatcgacttccagcgtggtcgcttccgtgcgcgtggggatgttttggaaatcttcccagcgtcatctgacgcgaaggcgattcgcattgaattctttggggatgaagttgatcgcattcgcgaagtggattcgttgactggtgaagtgacggctgatttggatttggcaaccatcttcccagcaacccactttatgaccaatgatgagattcgtgagcgtgctttgaagacaattcaagccgagttggacgcccaattgaaggtgtttgaagaagaaggtaagttgttggaggcgcagcgcttaaagcaacgtactgaatacgatattgaaatgattcgtgaaatgggcttcaccagcggtattgaaaactattcacgtcacatggatggtcgtgcaccaggtgagccaccgtttacgttgctcgactttttcccggatgatttcttgattgttgtcgatgagtcccacgtgacgatgccacaagtacgtggtatgtataagggtgatcgcgctcgtaaggaaacgttgattgattacggattccgtttgccatcagcgttggataatcgtccgctccgtctggatgagtttgaagaacacgttaaccaaattatctacatgtcagccacaccgggtgattatgaagaagaacgtgtgtcaaacaaggatgttgcgcaacaaattattcgtccaactggtttgttggatcctgaaattgaagtgcgcccggttatggggcaaattgatgatttgttgggtgagattaacgaacgtgtcgccaaagatgaacgtgtctttgtgacgacgttgacgaagaagatggccgaagatttgacggactatcttgaagacgtcggtgtgaaagttaagtacttacactcagacattaagacgcttgaacgaactgaaatcattcgtgatttgcgtttgggtaagtttgacgtcttggttggtatcaacttgttgcgtgaaggaattgacgtgcctgaagtgtcattggtagccattttggacgccgataaggaaggcttcttgcgcaatacccgttctttgattcagacgattggacgtgcagctcgtaacgagaatggtcacgtcattatgtatgcggatgatgtgacggcctcaatgaaggcggctatggatgagacggcccgccgtcgcgctatccaaatgtcatataatgaggaacacggtattacaccacacaccatcaagaaggaaattcgtggtttgattgcggttacccacgaatctgacgataacagcaacaagtctgcaagcttcacagaagtggccttcaaggatatggcgcgtccagatcaagaagccatgattgccaatttggaagatcaaatgcgtgcagcagctaagcgtttggacttcgaagaggcagctagcttgcgtgatgcggtgatggaattgaagttgcaacttggggtttaactccttttctgcccgaaaaggcctgttgagatgtgatatacttgatatacgatgtttatagaaattaggggtatatcatgagtttgaatttaagcgatattcaagcattgatgcatgattttgagcagagctcattacgtgaattcaagctagatactgaagaaacacatctttatctcagcaagaacgaccaagcaccaataatgatggcacaacaaccagctgccaacgtggcaactcagactgacgaatcagttgttgtggatacaacggtgacgattaaagcaccacttgttggtaccgtttatttggccccaaagccagaagctgcgaactttaaatcagttggtgacacagtcgctgtcggtgaaacggtggccattgttgaagccatgaaattgatgacggaagtaaaaagtgacgttgctggtgttattacggctgttaatgtggataatgaagctgtcgttggatacgatgatatcctgtatacggttcaaccggcatagtttgaaaggggttggaaatttttccagcctcttttcatttgatggagttaattatgtttaaaaaagttttggtggcgaaccgtggcgaaatcgccgtacgcattattcgcgcactgcatgagatggacatcaaagcggtggccatttacagtacggtcgacaaagaagcgttgcatgtgcaattagctgatgaggcaattgcggttggtggcccacgacctcaagattcatatttgaatatgaaaaatatcgtgagcgcagccttactaacaggtgttgatgccgttcaccctggttatggattcctgtctgaaaatgcgatgtttgtgaatatgttgacggatgttggcatcacgtttatcggaccacacgcagaaacaattgccttaatgggtgataaggcgcaagcacgtgaaacgatgcgtgcggcaggtgtgccagtcatccccggtagtgttggcacgttgaccgatagcgccgaagcaattgctgttagtgatcaaattggttacccagtcatgttgaaggcagccgctggtggtggcggtaaaggcatgcgtttgctaaacaatcgtgaagagctggcgcaacaatttgagcgcgcacaggctgaagcaaaattagctttcggttcagctgatatgtatattgagaaggtgatgacaaatgtgcgtcacatcgaagtccaaatcatgcgtgatcaacagggtcagacggtctttttcccagagcgcgactgttcaattcaacgtcaccaccaaaagatgattgaagtatcaccagcggttggtgtcacgagtgatatgcgttcagagctcggtgcgttggcggtcaaggcggcgaatgccttgtcttacgagaataccggaacgtttgaattcttggctgaccgcgataataacttctatttcatggaaatgaatacacgcattcaagtggagcacccggttaccgaagcggtgactggtttggacttggtaaagatgcagattgccgttgcagctggggaaccattgccagtccaacaacaagatattcaaattaagcaacacgcgattgaagttcgtttgaatgctgaagacccgatgcatgatttccggccaagcgctggccaagtcgactttacgtacttgccatttggcggcccgggcatccggtttgactcagcgatgtatgcgggtgataccgtgcaaccttactacgactcaatgttgggtaaagtgattgtttcagcggataaccgtgatgatgtctttaaaaaattggcacgtacgctagatgaagtggttgtgcgtggcgtttcaactaatctagcggtgcaacgggcattggttaaggatgaacgtgtccaccaaggccttgtaccaattgattttgtagagacggactttttgcctgcgtggtcaaaggaagaggtgcaagcgccatgacccaattatttgataatcaagctgataagtttaagcatgcgcctaacccagacgcgtttgataaggtcccggccggtagttgggtaacttgtgcctactgtggtgcccaacaataccaagaagaattgggtgaatacctggtttgtggtgtttgtggttacgggttccgtttgggggcgcaacaacgccttgatttgatgacggataagttttctgaatggtacgcggatgttgaaatgacaacgccggactttccaggttatcctgagaaacttgccaaggcgcaagcaatcacagacatgaaggaagcggttatgactggtgaagcggttattgatggacgacgaactgcagttgctgtgatggatgcgcgtttcatgatgggatcattaggcgcgaaaacgggtgagaaattagcccgcttgttcgacgatgccacagccaagcacttgccagttgtcctattttcggcttctggtggtgcgcgcatgcaagaaggtattatgagtctcatgcagcttgccaaggtttcaggggccgtcgcacgtcatcgtgaagctggcttgttgtatgtggttgtcctaactgatccaacaatgggtggtgtgacagcgtcatttgctatggaaggcgatattattttgtctgaaccacacgcgttggttggctttgctggtcgtcgtgtcattgaacaaacgattcatgaaaccctaccaaaggacttccaacgcgctgagcacatgcaagcaagcggatttattgatgcgattgtgcaacgacctgagttacagtcatacattggcaagttattgcgtgtgcatcaagtaccgttggaggcgtaatcatgagtgaattaacaccaattgaaattgcgtgggccgcccgtgaagaccgtttcttggcgcgtgatttgattgctaatatcgtgactgattttcaagaatttcatggtgatcgtgcacaaggtgatgatccagccgtgattggcggtgtggggatgctcggtgagcaaccggtcacgatgattgcgattaatcgtggtgatgagatggctgaaaagcttcaaacccgtaatggttcacctgaagcgagtggttatcgtaaggcgttgcgtctgatgcaacaagctaacaaattcaatcgaccaatcattacgttgattaatacacctggtgcctttcctggtaaaacagcggaagaaggtggtgtcggccaagcaattgcggaaagcatcgtgcaaagcatgtcgttcaccgtaccgatgattgccattatctatggtgaaggtgggtcaggtggtgctttggctttagcgacagcgaaccaagtttggatgtttgagcattccatttatgcgatgctgtcacctgaagggtttgcttcaattatgttcaaagatgccaagcgtgcaccagaagcagcagaactattggggctgaccccacaagaacttttggcgaaaaagattgtggaacgagttatccttgaaggcgatgatcgcgacctgttttatgaaaacctgcgtcgtgatttgctacaaacaattgacgatttgttccagttgggtccagaagaaattaggacgcaacgacaaatgcgatttgataaatactaaaaacgaaccgtttggttgacgcatgtctgctgaacggttttttcatactctcagcacctatgttgacgtcttaactaaaataatttttaacgttggtaaggaaatgtttggcaacggaaaagtcgtgctatctttgagaagcttcaaaacacgtccagactggaatgacgtaaaaagcttgcgaggaggaataagaatggcaaagtacgagaagggtaaaaagccgttatacaagcgtatttcattttggacgatgctggtgatagtggtagctgtaatcgcaaatatttcaggcggaaagtcgtctgaaaaacgtgcaaatacacctagcacaacggaaaccagcacagcacctgttccaaacgatgcaacgaacgagcaaaaaaacgctttacgtcaggcagcatcctacgccggtcatatgcacatgtctaaagcgggcatttttgaccaattgacatctgagtatggtgaaaaattcaatcatgatgatgcaacatgggcgatagaacatttaaagactgactacaacaagaatgcactggctaaggccaaagactatgcgaatcaacaatatatgtctaaaaacggcctttatgatcaactgatgtctgagcatggcgaaaagttcttaagtgaagaggcgcagtatgcggtcgacaacttacaggcagactataatgaaaatgcgcacaagaaggccgaacagtatcaaaaggagcaaggcatgtcttcagacgccatatatgaccagctgaagtcagagtacggcgaaaagtttacaccagaagaagcgcaatatgcggtagatcattgcaagcctaacgctcacaaagaatagctaaatcaaccaataaaatggcatattttaagcacggacgttttctataattggactgtataaaatagtatgctgtctaattaaaatgaggataaaccaatgaaaaatattgttgccgataattatgctgaaatgagccgtttagctgcccataagttgctagcaacgatgcttaagcctggtcgtgtaaatatggcgataacggctggaaatacgcctaagggagtttacgagttgttggttgaagaagttgtgggacgtgattattatgagaacgttcatttttacaactttgatgaagtgccggtcaacggtgaacctgaaggtgtgacgatgactaatttacgtcgtctattctttacgccggcaaaggtgtctgaatcacaaatcgagcgcctgacacctgagaattatcaaacgtgggatgaaaagcttacagcggatggtggtttggacttgatgttgatgggccttggcgctgacggtcatttccttggtaacgtgcctggtgccaccaagtttggcaatcagacatatcgcgttgaagctgatgcgacaccaaccttgcgtgaggtgctagttgacgaagttggtggtgatgaaagtaaggtacctgacttctatgttacgatggggccacagtctgttatgacccaagtgcgtgatgctgtcatgattgtgaacggtaaaggtaaggcggcgatggttaagcaggctttctttggaccggtcacagaagatgtgccatcaagtattttgcagctacatcctaatttcacgttgattttggatgccgatgcggcgagcgaactgaatctataatacaaatacaacctcagtggctgttcttgcggcgattgaggttgtatttgttttttatcggttgaagctcgtatactgactgaaacttggttttacgggggtaatggggatgactttaattgaaagagtaactgacttagataactttgagagcgagcgctttttgtatcgacatgctactgaagaagatgccgctgatatgtttgaaatgtttcataatccagaggtgctaaagtggattcacgtaccgatgccggaatcaatcgcacacactttagaaatcagcataaagaaatttcatttagctgatccactgggcaagtacgtcattgttgaaaaagcaactaacaaaatgattggtagcattgatatccgaccaaccgagaaaaataattcggctgaaattgggtacgccttgaatcacgcttattggggacaaggagttatgactgaagcgctacggacggtaattgcggttgggttcgaacaactagagttgcaccgcattgaatcattccatgcaccagaaaatattggctctggacgcgtaatggaaaaggctggcatgcaatatgaaggaacgctgcgtgattatgagttgctaccaaatggtcgatacgttgacagtaaggtctatagtattttagcgactgactattttaaggttgaagtttaattgttagataaccatgcgtaacgccaatattacttgtgattagtcacgacaaaacgtaagatggagataagtattattcagttcaaaggaagtaataaacatgtcaaaaacgctaattgtgacacacactgacctagatggcgttatgtcaggcttagtcgctaagtatgcgacggcaaatgaatcggatattcgttatgcagatgctggtgctgctggtattgatgccgtgctggaagatgttttggctggggatgatcaatatacccaagcaatcttcttggacaacacgccgtcagccgaaatgttggctaagttccataaccaaaccaacttaaccccaacagtttatgaccaccacgtttctaatcaagacgtttgggaatcagccactgttgacgccacgtttgttacggatcagactggtacgtcctctgcgactgagttggcgtttaatgacaatcaaactgcactggcaaagttaccattcctaccagtcttggttaagttgactaacttgtacgatacgtggacttggcaagatgagcgctatgctgatgagcaacaaactggtcaacatgcgcaagtcttcaatgaagtactcaatttcattggtcgtgaccgtttcagtgcgtttatggatgaagcagcgaataagacgtttgctgaagctgatgtgccaagtgccgtgctagcaacgatcttctcagacttgattatggcgctggtgtacgaacgtattaagtctaaccaagactacgttgctaagaaggcagaaaaggctgaatttgctgatttagttttgcctgacaagacgtaccactatgcttatacaacagcatctagccagatgtcagaaatcgggaatgcgttgactaacttaccagatgtcgatttcggcttggtcattaataacggcaagttgtcattccgtgttgcgaaggataaggatgttgatgtctcagtcattgctggctactttaatggtggtggacatgctaaggcatcgggtgcgaagttagtgatggattggccaacaatcattcagaatgcgcgcaataaataaactgtttgtagggatagattggttgtcgccagactatccttttttgctgtatagccattcaaggacatacaatccggaatatcggtccactgttttgtaagcgttttcaaaatataaagacagccaaaaccaatcttaggtatacacttactatatggaagcgagtaacgaagttgtttttacaaatagggggattaaaatgacttacaacgcaagtacagcagaagaaaagttagacattattgacttgccacgtttgcgggctttagtcgagtcacgaacggaggcaggggcatttggttatgttgatggtggatcatcggatgagcaggtgctccaggataatgaaacggcatttcgtcattatcagttgattccgcgaatgcttcaaaacattgcggagcctgatatgacgacaacgctttttgacattccgcttgggatgccgattattgcagcaccaattgctgcccaaggattgatgcacgaaggtggggaaagcgtcactgtaaagggtgttggggcagcaaaatctattttcagcgcgtcgacctatgggaatgccagtgttgcagccgttgccgaggcgtcaccggaaacaccaaagttcttccaactgtatatgtcgcgtgatgatgagtttaatcaatttttgattaatcaagcagttgaaacggggtataaggccattattttaacggcggactcgacgttaggtggttatcgagaagccgatattattaataacttcgaatttccgttgccatggataatttagcggccttttctaatgcggctggtacaggtgagggacttagcatcgctgaaatatacgcgcgcgccaagcaagacttagcgttgtctgatattaagaagattaaggatatggcaagcggtttgccagtgattgtaaagggaattcaagatccagaagatgcattggcagccattgctggtggtgcagatggcatttgggtgtcaaatcacggtgggcgtgaactgaacggtgcaccggcttcgattgacgtccttgctgacattgcgaaagccgttaatcatcgtgtgcccattatctttgattcaggcattcgttggggtgaggacattgcaaaagcaattgcgcttggtgcagatgtcgtagcgttgggacgcccaatgctatgggcgctcaatcttggcggggctgcaggagttcagtcagcttttgaacacttggcggaggagttgaaaattgttatgcagcttacgggttcccacacagtggccgaattgaagcacgcaaaaattattgaagcgaaattttagtttgtaactaagaattgtcagggataataatgcatttaaaaaggatcgaatgtatattcgatccctttttagtgtatgttgatgcccaggctctgaataagcaaggcggattgatacgtattaattgtcataccagcagctagggctggatcaaataataaggtttcaaaatttgcatttgatacatcaaggtttgccagcttactaccagcaaaatcactgttatcaaggtcactttcgacaaaacgaagtgtttttttaatgcgaatgccgtggaagaaactatcacgaacacgtgtgttattgaacacgacgttttggaaggtcgtcccgctgacgttgatgaaatcagccaatgagttgttgatttcggtatcgcgccactcactttgcagacctgagaagttaaccccagttagctgggtgttattaaaactagtgcgatagaaaatggcgctagcgaaatcagtatttgataaatcaacgtgatcaaatatgacatctgaccaagtactatctgagaagtcatcttggtcgaacgtcacacgttcaaatgtgacatcctgtatgttaatggcacgactagagtaggtgaagtgaacattacggtaggtattgtttggtgtaacatcatccaaactaattgtggtatcagaaataagcatgaaaactctccttaagacttaaaattttaaacaatccccagccaaagtaaaagcctcacatcaactaaggtgcgaggcttcatttgttattcagcagtttctgtcaaaccttcactcaaggctttaatcttcttggttgcgaaccacaagagtaatccagcaacaatcgtgataataccgataatcaagaagtaattgatttcagtagactttgagtaaagttgtaccaattgtgcgttagccgcttgcgccgttgcgtcagacaagttccagaccgtcaacatttgcgcttggaaggcaacgggtgccatcttagcagatgccgacaaaccgactggtgaaatcaacatctcaccaacttcaaccaatgcccatgaagcaactagccacaatggattgaattggtgattaacaccaaacatcatgcctggcacggccatccaaacgaatgacaacccagcaaatgccaaaccaagtgagaacttcacgccagttgagggttgcttatcgcgcaatttctttgaccaaagccaaacgaagaatggcgtgaacaacatgatgaacaatggattcaatgattggaaccatgaagctggcataccgtgtagcgccgtttgatttgaagcgaacaaggccaagacaactgagccctgttcctcaattgaccagaacagcattgccgcaatgaacaagggaatgtaggcccaaacacgcttacgttcggccttagtggtcttctttgaagtcaacatgacaacaaagtaaatcactggcacaaggatggcgacgaacgtcaacaagttaatcacactgttaattgacaaactgtgcgtaccagccataatgccgataatggcaatgaatgcgataacgattccggctaacttccacatcaatggggcgatttcattaggttgtaatggggatggtgcttggtgtgagacatccttaaggtgcttacgaccatccaatgaatattgcaccaaaccgaagaacatgccgatagcggctaacgagaaggcaacgtggaagttaacgtgcacttggaaccaaccaactagcaacggtgcgataaaggcaccgaggttgataccaaagacgtagattgagaaaccggcgtcacgacgttcatcattggcgtcatacaagtttccgaccattgttgccacgttgggctttaagagtccagttccgagcgtaatcaaggcaattgagccaaacaacccaatttcatgcaatggcatcgccaaggcaatgtgaccgaacatgatcaagacaccaccgtagaaaacggtacgccatggaccaaggacacggtcagatagataaccaccaacaattcccgataggtaaaccattgacccataaatcgacatgatagcagcaccggtggcttcgttaaatcccaaaccgcctttgtcggccgcataaatcatgtagaaaagtaaaatggcacgcatgccgtagtatgaaaatcgctcccacatttcggtgaagaacaaggtcataaggcctcgaggttggccgaagaaggaggtgtcgcgtttctgttccatcagaaaaaaccctcactcttactggttatatttttgtctagcgaaaaattgtttccgcaattcgtcataacgatagaaactagtctacgccgattatgagctgaaatcaaatgataaataagtattttctcatagtgcaataaaaaatagcggttgtcgcctgacaaaccgctatttttgttctcattaaactattaaagtgtgatagtttcagcttctgcaggtgcaactgctggttgtggcaagatttctgccgcagcttcacgatccaacaacaacgtgaagttagggtgggcttgcaagattgaagcaggtacatcttcactgattgggccaaagaaagcttccttaacgatttgtgccttcttcttaccgaaagcaatcatcaagatttccttagcactcataattgtcttaggacccatggcaacgtaaccctcaggcaccttgtcttctgaaccaaccgtgtgaaccaatgcagcgtatacttggtcgttagcttcagaagggatgtagcgcgtaccgtcttcaaacttcgtgacacctggcaagttaccagcgtaacgaccatctgaaccaattccaagcaacataaagtccaaaccgtttgcttcggccaaacgctcgtccaatgtatcccagtttgacaagtccaaacggtggtaaaggtaagcaggcatttcagcagggttcaagaagtacttacgcaatgttgacgtcgttgtaccttcttcagaaccagcttgtgggacttcatcaaagttccacatgtgcaactttggcatgttaggatcgtggatacgctccgtgaacttttccaagcattgctcgtatgaagcaacagggcttgttccagccgtcaaggcaatgttttgtaccttacgatcgtaaatcttgttcaatagaatctttgatgtctcgttcgtgacatcttgctttgtgtctacaatttcaattcgcatattttttaatttccttctcttattaactgtcagtttgacttaacactaactagtttataggggaattttgaacaatgtttgaattaaccaccggaaattatgtgaattggtatacattggtatatgatgaaagcgcaaacattgccagaacaacgtttgcgctttcgagtgtcttaatgcttttttaatgaattgagtgcatcttggatgcgagtttgtgcttccgtgatacgttccaaacggggcttgttcttgaaattcattttctcaacttgaatttgaacatctttcacaagtgcttgcacggctggcaactctgcttggacattggcaagggatgccttcacatccttagtcgctgatactgtccgctttgtgtccgccgtgaagttcgtgacttgctgcttcaagttggtaaaccaatccttgagtgcgtccatacttagtcctccatatgactggcgatgttagcagccagtgccttgtaagtgtcttcggctgtttgttcactgtgatcaggcattggaatatcaaaaccgtcattggcataacgtggaatcaagtggaagtgagagtggaagacagattgtcccgcagcttcaccgttgtttgacaaaatgttcaagccaataatgttttcgtcgctgtccttaattgcacgggcaatttttggtagctttgacaaaatacgcgcagccaaagcttcatcatattcaaagatgtccgccacgtgcgtctttggcacaaccaatgtgtgaccaggcgttacttggctaaggtctagaaaagccaatacgtcatcatcttcataaaccttataagcaggaatatcacctgcaacaatcatatcaaatacatctgccatggaaatgcctcctaaatatcatctgttatcttcattataccctgactgctgtaaactgtccgttgttaaatttcgatgaaaatttgctattatataagtacatagaaaaatcgagagtgacattatgacattagaaattgaacacttatcaggtggctacggccaactaactgttttaaatgatgtctcattcactgtaccagatggtcatctaacggctttagttgggttgaacggatctggtaagtcaacgacaatcaaccatatcattggtttgcttgcacctaagcaaggttcaattgtcttgaatggggtaacactacagacacaaccagaagcattcaagcgtcaaatcgcttacattccagaacaacctgtcctatatgatgagttgacgttgcgtgagcacttagccttaacaatttcagtttatcaattagatgaaaagacggcttggcaacgcgctgaagaattgcttacaactttccgtttggataataaactagattggttcccaactcatttctcaaagggaatgcgccaaaaggttatgattgtgatggccttcatcacggacgcgccattctttatcattgatgaaccattccttggactggacgttattgcggttaacgacctgttagcgctaattgaccaacgcaagcatgccggtacgagtttcttgctaaccacgcacgtcttgacgacgctggctgaccacgcggatgaatttgtttatttgcgggatggtgaggtcgctgcgactgggctggcaagcgaattcgccgaaaaggtacctgaattacaacaaaaagaggtgtaaggatggctatcgatcatttatttaaagaacgttggcaacgggaatggcgtcaatatagcaaatatttacgttatgtctttaatgaccacgctatgctagccttgctgtttctattgggggcagctggattggcgtatcggcaattgtgggagagcgcgccagttactttttggacacggagcttattattacttgttttgttactaacgctggcattgttcaagacacccgcaagttttgtaaagggtgctgatccagtattctttatgggaaacgaaggggtactgcgtcgtttgtttcaccaagccacgatttatagcgtcattgttaacggtgtgattcaactaattctaaccgtgctactttggccaatgatgtttcgactactcacgccaaaatttgtgacgatgttattggtcaccatcgcgctaatggcggttaagatgctgtttgtctttatgaaagctcgtcggacaaccttgtttgatacaacggttggtaataacttaattgactggcgtgccgtggtggctgccgaggataagcgccaggcagcaatttttagcttctttaatttatttattgatgtaccaggaatgaagcctgccgttcgtcgtcaacgatgggctgatcgtttgattggacattggccaaatcagtcacgaaacccattggtccgattgttagtgacgacgtttgttcgtcaaggacaatattgggatgtatggggacgtctaagcctgattggcttgttggttgcgtttgtgacaactgggtggttgcaaacagttttgtttgttatcttgttctacctattggtattgcaattactaccattggcaagcgcacaccaatcattggtgtttgaccacttgtacccggtaacggtggcacaacggcaacaagcatttcgcaatgcacttatcccatggcttgcggtaaccggcctgatttgggcgattgtaggtggtgtactcgcgggttctatcacactcttattacaaaatgtcataggacttgtcgtagtaggtggtattttgttattctggtatacgaaccgcattattgcaaacacgtttagaaggagaaattcacgtgcgtttacgaaataaaaagtggactagcccatggctggcagatcacacggacttggttattacacaagaccgtgcgacaggtctacaaggaaattggcaaagcatcttcgaaaaggtgcaaccattgtacgtagaaatcggtacaggtaagggtcaatttatcattggtatggcaaagaagtacccagaaattaactttatcggtatggaaattcaagaaggagccgttgctgttgcagcacgtaaggcggatgaagatccagtcgacttgcctaacttgaagttcatctacggtgatggtgctggagttgagacatactttacaaagggtgaggtatcaaagttgttcttgaacttctcagatccttggccaaagtcacgtcacgaaacgcgtcgtttgacgtacaagtcattcttggaaggttaccaagctgttttgccagctggtggtgaactagaattcaagacggataaccgtggcttgtttgagtactcactatactcatttgcaaacttcggcatcgaattctacaaggatggtatctcactaaacttgcacgaagacgaagaaaagatgaaggacaacgttgagacggaatacgagcaaaagtttgcttctcaaggtttcccaatttacaagtttacgggagctttcaagtaaccaacaaaaaacgcatgctgactaaccaagtcaacatgcgtttttaatttattcagatagtgtcgctggagcttcagtcataacagtcaacgtaacagcttgctttgatgcttcccattgtgcctcggcaccaaatccaatttgttgttgtgtttgttgggcgataaacccagcttccaatgcaaaactagcctctgggttctcgataaagcgggcttctacgattggtccgtctaggcgccacttttgcatcgttggcttttgcgttgtgagggttaatgttccaaaaccggcctcttggaaaaaagcttcgatagctgagataccgtgtaggtcaacatctcttgctaaggtctttccggcccagtagataatttctgactgatcatcttgtagtaattcaggtaacaaacgatcacgtagcaaggttaacgcgaacacgtcaagacctggcgtttgtgctgattccgtcatgatgaactccttttattacagtttcatagttttaattatagtgtatttgagcttgatttgccaataatttacgttagtgttacaattaaagccttgaaaggatggattttggcatgactttacctgataatccgttaataaatagcacgctaggattaatcaatggtgacctttttgcacaaaaaatcatcatgggtgacggttcgcagtggggaagtgattcttcactaacccttgcaaccattgcaagtctttctaacggctatatattaaccgacatcatgacccagttctcttactggtacacgaccggcgcctatacggctgacggtgcaccacaaacggctggggatgtaacaagactcgcaatcgaaaacttccgacagacacaagatccgttcacgtctggtggtcgcgatgtacaggataacgccaatggctcactgttgcgcattacaccggttgtactgttcttgtatgctaagtatggctcagacttcattcacgatgatccagccatgttaacgttgcaccaaattggtggtttgacacacaaccatccgcgttcattgattgcattggggatgtatgccatgctaattaatggcttgttaacggggatgaagctacctgaagcgttcgactttgcaattagtaatgcgtatgagtactatgcaaagcacgcggtgtttgctgatgagctagaggcgtttgaatcattgaacacgcccgactttgaaaacatgccaatcaacgagattcacgcttctgggtatgtcgtggatacgtttgcggcgacggtttgggttttgctcaatagcgataactttgaggatgcctttacgctggcgtcggggatgcctggtgagccaatgcgtatcatgccactagttggtgcggttgctggactaatgtacggcaaggatgcgttgccaacggcatggttgaacaatcacgagaaagatatcgtgacgcgtattttggaaacagctgaccaaagtggtgagtttgtttgcccaacacctgaaaattaaatatcacgaaggggttctatcgttttggtagggcctcttctttttagacacggagaggagcttagaaatggcaacgattatacacagtatctcaggggttctaatgattttgggactcgtcgcagttgggtatgctttgataaagttgcgaatctttaacgatgacgatggcagattgagcaaattcttatctggatttgtcactaaaatcgcaattccagcttatttgattgttagtattccgcaggactttacaccggctagcctcgtcgctttggggcctaaattgattctgccggtgggtagtatgttagtgctattcattttgtcatttgttgtagcacgtttaattcatgtaaacccaacccataaaggtttgtttcagtcgcttttgtttaattcaaatacagtgacggtcggactaccggttaatatggcactgtttggtaaggaaagcttaccgtatgtgttggtctactatatggctaataccattgttttttggacgttgggtgtttatatgattgagagcgatacgaaggcgggtaaacatttcgacttaaagaagacgctgaaaggggtgtttacactgccgatgattgctttgttggttgcgattgtactcgttattttccaaattaagctaccggagttcctggtaactgatttgacggatctggggaatacgaacgtaccgctatcattaatttttatcggtttttcaattgctaagacccaacgtgctgatctgattcctgataaagaaaacatcacgttggcaattggacgctttgttatggcgccaactgttatggcgttgatgatgatgccgtttgacttgcctaagttgttgaaggtcgtgttcatcattcaatcggccatgccaaccatgacgaacgctgccgtgatggcacgtgagctgaacggtgactataagtttgcgtctgtgtcaattacacaaaccacgctaatgatgttggtggttattccaatattgatggttatcgttagctaattttttataagtttgcgcgattttcaaacaaggcgacgcagataagcttgctatcataagcagatatttgaaagaatggagtatctactgtatgaaacagtttactaaaattagtcttgtgactatattatcttttattggtgttatattgacggtcatgtttcgtgatgttgtctttcaggcggttggtccagctattggactgtttgaaaatgggcaaccgacgcctgtggctggaaccacagtcttatttttctggggtatgttagttgcgatgctaccgttgttagccgtaagactcaaatggccagcacgttttcactttcaaatccgcaacgatgtgaactggaaaacggtgtcacctgcaatcgttgccataatttgggcaatgtcaccacaactttgggatacaattaaagccttaccgactgccggctttacgacgatttaccacaactttatggacggtttccaaccagggttcttcgaagaacttgtggtgcgtggtgcagtcttgatggcattcttgtttgcaatgaaccgtggtaagtatcaagcactcggtgcggctttgggatcatcaattatatttggtcttttccactttattaacctaactggtggacagccattgggcgatactattcaacaggttgtttatgcaactggatttgggttggtatttgtcgccatttattaccgaacgaattctttatggattccgatgattttgcacgggttaacagattttaccggtgattttcaggtaggcactgcaggtgaagggtggctagatatggttatttatattctgccatttacactgattgcgctctggatgttacgtccatcgatgaatgactacaatttgaagtcattccctgaggtcaatgacccatcacttaaatagtaaattaacgctgcaggtgttgcctgtggcgttttttgatgggcgagagtaaagttgagagaaaagcagggagactagtatcatgggatcacgacttatgcatgcggcgattgcggcgttgctgatggcgaaatatcatcagttagacacgacattcctggttggtaacgaagcacctgatgtcgataaaatcagtcatatgagtaaagacgaaacgcattatttagttcctagtaatcgaggaactagacgaattgatttacgggcttttttacaagagcatccagaaacgttgtcagattcgtttaccttgggctattacacacatttattggctgacgaggtttggcttacagacgtcttcatgaaagtcgttccaccacaagatgatccacgacgtccagcagtgctagaacgctactatgaggattttaaaaagctcaatccgtatcttgttcataagtatggtttacaaccattaccatcgacagctactgaggctgtgccggcggatttcgcagataaggcgtgtgttgaaaagttgattcaagactataatgctgactttacgggcgaaacaattggtgatcttgaagtacttagcattacacaaatagatgtctacattgccaacgtggttaatttgatgactaaggtcattgattcgggaatttttgtcgaaaaataaaaacataaagattgataggtcaccggtaagcacgtattatggccagtgaactattagaaataaggagaacaacatgacgttctataccatagaatatttatcacaacgtcattcttggatggagacagcaacgacaattgtaatcgctatactggtggctatattcgcaatttttgcggtgttgtattttaagaataatctgaagtctaaatatcgtgatttaagcgtgatgatgttgctgttagttgctttcgttgttgggcttcaataccaggacatgaatcaaatcaaaagtcagtcagcacaaaaagaacaggttgtgaggctcctaaagcatgttgcccatgcaaatgatgttaaatatagccaggtgtcaattaatagcgttaatctgaataacaatttgattatgaaggttgataacgtgttctaccgggttaatttaagtgcagatcaatcgaattacacgcttgaaaagacgaatttacttgatgagaacacagtggttgaggtgaaataatggatgcaagttatgcaacgattgctttgaagctagcaattggaatcatcggcttaattatccaaattaatattctgggtaaaggtaacttagcgccgatatcagcaatggatcaggtgcaaaattatgtactcggtggcattatcggtggtgttatctacaatagcgatattaccgccttgcaatttgtgttggtattgattgtctggacgtttttggtgctgttactgaagtttttgaaggaacacaattattgggttaagcgcgtgattgacggcgcgccagtgacagtaattaaaaatggtgaagttgatgtggcgacaactatgcgtgttggtctatcagccagcgaattaatgttcaagttgcgcgctgctggtgttgatgaagttcagattgtgcgtcgtgccgtccttgaacaaaatggtcagttaacgatcattaagtacggtgaagaagcgattaaatacccacttatccaagatggacaggcaaattacgacttgctcgatgtgttggataaagatattgattggttacgtgcagaagtttctaaacagaaaatgggtggtgtggaagatatttatctgggtgaatttatccacggtaaagttattctgcatccgttcgctaagtaaaaatggtagtcatgacaacgatgtgtcgtgactaccatttttagcatacgtataagtgtttatgcagtgaacaacctggattaaaaggtgtttcacattggtcgcattgattaatttcgtcataacgggcgtaggtcatctgatgaccacagacgccacacatgacaattaattggttgctgcgttgattataacggccaaatgcgtgattttcagtattgttatggcattggtaacaagcatataacttgccacaggtctcgcaacgattggcgataacgtcaagtttcgaatgccagtgaacacatcgtccatcagaatcgaccaattcaccatatattttttcttttttcatacttatatgctgtcataaatagatttactaagcaagtctgcgcgaaaaaatgccgataacagttaaaagttagtctaagaatatcgagtaatctatattttcggacaattcactatgtaataataagtagctggaggtggcatatgaaagcagcaataattaaccagtttggatctagtgatgaattaacggtcgttgataattatgacgaaccaatcatttcagataacgaagttctgattgaaacgtttgcaacaagtgttaatccgattgactacaaggtccgtgaaggtgctttgcgaggtatgtttaattggacctttccagtggtcttgggttgggacattgcgggtatcattactgaagttggggcaaatgttaccgaattttcggtgggtgatcgcgtttttgcacgtccggatatggatgcaaccggtaaattcggctcgtatgcaacgtttatggcagtaaatgtcgataaagtggcagcgatgcctaataacatgacgttcgctgaagctgcagccttgccattagctggggaaacagctttacagatgttacgtgagttacgagtgacagatggttctaaggttctagttcaggccggcgctggtggcgttggtatcgttgcgattcaattagctaaattgatgggtgcaactgttgcaacgaccgcaagtcatgcaaacgcggaatttgtccgtgaacttggtgctgatatcgtcattgactatcacgaacgtgcgattaccgacgtgattagcaattatgatgcggtgctagacagtgttggcgatattgatgcaggcttagatgtgttagcgccaggtggccgattagtgacgatttcggctaagccaactgatgaacaattgtcaaacgctgaaaaggcgaataaaacgctaacggcggggtggctacaaccaagcggcaaggatttagaggaattagcggcatattatcaaaacgatcaattgaaaatcgtgattgattcaaagttcccattcacgacagagggcgttcgatcagcgcatgaacgtgttgaatcgcatcatgcacgtggtaaagtcgtgattgaaatgaaaccggaatagttatgcagaacacaacgatggtcttctggacatattgttgtgttttttggtgtataaagacacttgatttcccattaaaaagaataaaattagcggttgaattaaagtgctatacttactgataataaatggttgaggggtattaaacatggtaaggattatttttaggccacatgatttgattgcgttgccatatgtggtttttatggccacaattgggctgttgatgttcatcgatagtgctgcaggacgtattctttggggtagtattggactatttgtcggtctaattagtttaattggtgtgaatgcgatggtacgtaatcatccaaaagacgagtttgacgagcgtatttaaagcgtttgagaacggtggtatgaagtatggtggaactgacaatcgttgtagttgttgtcgtaatatttgtcgtcgtaagtctcatctctgttttgatacaagtgcacacaaaatatcgaactcagcaacataagtggcgcattgcttttagacggtcattcggttggattggttatttcatttccaatgtaattttgttttggtgaggcgtcagatgtttggtaagaaagtaaatgtgaagcaactggaatcactgattgatgcggctttggtagttgaaaaaaatccagaagttgcattagaattgcaaaagttagcaaaccaattaaaaacgtcaactaaaatccgagaaactgagaaaaatggctatttggcaattacaaaacttgcgaatacgtcaggattcagaatcagtacggcattgtttacgttagttgaacggttgagcttagatgtgtatggatcggtccatcaattcaatgtgttttaaaagaaaataattaacgctgcaaagactaaatgtgtttttgcagcgtttttttaattggtaggttggtaactagttttaatgactcaggtttacatttattttagtttacataatatatattatcgtgagttgttattttaataaggaggtggaccgtttaaatatcgttatctatgatacactgtccgataatacatttttgggaggttctacgatggctattcaacaaattgatacacaacttgcaaccgacttcatcgttaatcaattaaatacacagcaacaaactctttttgaagttgatcatctacccgaatcgacgatagcgtttgctgacgtaactgatgatgttgttattggcgccttggtgcttaaagtttttggcaatactgctcacatttcattgctagccgtatcatctgagtatcgcggtcacggcatcggccataatcttgtggatgctgccattaagacttctaaatcactgaatctgctacatatcacggttaatacacaggattatcaggcgcccgatttttatcaaagttttggctttagtatctttggtcagcttgcagacacaccgtttgttggcactaccaaatactatctacaaatgacgctgtagttgctgacgaatcacagttcacaagcttattttagtgccatgaaatttgtgaatactgataccaaaaatgcgatcgcaaaaaagccgaaaaatgctaattgccatttctttttgccgtcaatgtacatcattaggtatgacaagcttaaagaaccccaaacaacaaggctgttaattcgagatggccagtccatcaagatgccacctaataacagaatcagtgccaatgccgcgaagataccggcggtgattttaaatgtttttgtgtttgccatgttatttagcctcttttattagttactgtttgtgataatcgtaacgtactttgctattgtttatagccgttgtaattatttcctaaacgaaatataaatgttataagtcgctattacaaatgaaaacgattacaattaaagcatatattgattgacctggatatgaaaggagcttgcaaatgctgtacatcatattaatcacaacaatatttgtgtctgtttatagctttcgtcatactaaacgccatctcgcaattttcaacaacccacgaatggcatttggcttgctgatgggacttacgactttttacatcttggcaccagtttgggtaattgtattggcccaaatcaacattcttttgtcactgattccgatcatcgcaatgcttgcaaatgcctatttcacaaaatctgctgttaaatactacaacgatcatatcagtagttaggaaggaaaaggatatgctaacactcctcttcggcctgttgatgctcgttttgggtgtactggaactctatctgacaaaacaagcagttaagacctatgaacgatataaccaatcacatgctacccctttcaagttatggggagtaagctacggttattacatcggtgcagcgctcattttattatccctgggaccaatcatcacaggaatatcatcaattatttagaaaaacgaccgggaaagcctcagtggtacctttcccggtcgttttttgattgtatatgttgctattgaatacttagttcccagggtataaagccttaattgaatcgatgcatcgtgaaataacagtctttttgatgtgactttgattacgtggtgtgttgcgttcaacaaacgtgccgtgtattctgtgacgactgttagtctctttcgcaagttgcttgaaaatagcaattcttttcttgacttgaagttgcttttcttcggttgtgagattatcaaaagcgttcatgtctgtgtagacaccgtgttctttgaaaagctttcttaattcgcctactgtactctcgcccacacctttttgccctaggaatcctattggattatcttgcttcacccgattctcatcccgggaagtaaagtaaccaccgcctgatgaaacgatgacatactgatcatcaggcgcgttgcggaataaatcgtcctgggcagttgcttcataagcattagctttcgcgatggtcggcacactggccagcaaagcgacagttgttagcaatagtaataatcggtacacgtttttaggcattttggattctccaagtcataaggtaatcaaagcataacatgagacaaaacacatattcaacgaggcaaaaataagtaagatctagtaacaacgcaaatgttacttacatgaataatcctaacaaactgaatacaccgactaccaatgcgacaccgacgacaatcttctgaaccatcggtgggaactgccagcgtgttggtaagcgacgcatggcccaccacatgacagctaagttagcgggcaacattactgctagactgtactgtgccacgatgatcagctctgatagtgcctgctcttggccgtggtacaaaaagacgatgataatcacaggcactagcgtaaatgcccgtgtgattatacggcgccataccattggcaaacgccactttaataatccagtcatgacaatctgaccagctaatgtactggcaattgacgcgatcaaaccggtaagcaaaagcgcaatcgcaaaaattggtgccatgacggtcggcttcaacgtatcgtacagtgcgctgaacatcacattactatgtccgatttcagtaaagacgaaccatcccatcaataccaacagcacgttgacaacccaagaaccaagtaaatggatcgttgtatcccactttgccattcggagcatgtcgcttacttctgcatcgttttcacggttgtatggccgcgctttagccaattcagaatgcaaatacaagttatgcggcatgatgatggcgccaaccaaactaacacttagccaaccgaacgagcgaaatggttcgtgtactggttgggtctctgccaaacgatgtggttgtagcacaaaaataaagccaattgtgacaacaatcatcacggcgacggctagtaactcgatacgacggacaccgaacttaaacaaccacagaaaaataataatatcgaatacagttaataacgtggttacttggagtgaccaaccaaacaataagtgtaatgcaattgcagtcccaactatggccgtcaaatcagttgcaatcatcgctagttcattgaatgcccaaaaaccgattcggactggcttagacaacgctggtgcaaccaattcagctaggtttttgcccgtaacaatgcctagtcgcgcactaaccaattgcaagacaatcgcaaatacgatagccaaggtcataaccggtagtatccaccagtgaaatagattaccaccgacaatcgcagtcaaccaattaccaggatccatgtagccgattgcgactaatgacgaagcaccggcgtatgacaagaaccgttgaaaaaatcgcttatcgaacataatcactcacaatgctttcgtacattttcgctaatgctggatcggcatttagcggtgatactaagctgaagcggtcaccacccgccgccttgaatgtttgcgcagcggtaatcttcaattcgttcagcgtttcgagcgagtcgattacaaaccctggtgttgcaactagtacgtttttgtcaccgtagataagtaactctgtcaaaatgtggctggtatatggctttaaccaaggcgttggtccaaattttgattggaatgtttgaacaatttgattgtcatccaattgcaaggctgttttaagggcttctgtcgtcgcgtttacctgctttaggtaatcatccccctgccgcacatagctcgttggaataccgtgatatgacaacatcaacttatcatagctgtttgattgccagtccaccttaatcttctcagctaaggcttcgatgtaggctggatgtgtctcgtacgagaggataatctgtgcatttggatcagcagccgtcgctttttcaacgattgtctttgtcgtcgttgttgagtattgtgggaataatggcaccacgataatatcatcggcgccattttcacgtaattgttgtagtcgatccggaattgttggtgaaccgtacgtcattgcgtagtcaaccagccagtctggtcgtaagtttcgcaaattctcagctaacttcgctgtgtaaacagttaatggcgatccctcttctagccagatttcacgataaaaggtcgctgatcgccaggtgcgtatcggcaaaataaatccgtttaaaatcacttgctaaatcggttttggcacatgaatgacattcggatccgataaaaattcttttaaatatggcttaacgtcaacattgtttggactagccggtgttcctaaatttaccaacaacacacctgttgtcatggttgtatcccccaaaaatatcgtaatttaatacataactattttcgattgtacgatattttgtagaaatgttcacatgtattttgatagtaaaaaacccacatctttaatgtgggtagaaaattttttacgggctttgttggtattagattattcagactatgccaagaagttggctaacaacattggtaacatcgctgatgcggttgggaatgcgtaaatcgtcttgttaaggtcgtcctttgtatatttatggttgatgattgggacgagtgtattaacaagttccggcgctgcatcgccgatgattgcggcaccaaccaattgcttatcacgattcaaaacaattttaaccttcgcttcctgatcgtgatgacttgcaaacataccgagttgcgcaaaattaatattgtgaacttgatactcatccgaagcattggcttcagttgtagaaacgccgatttgtgccatgcgtggcaacgtaaacgttacagtcggtacagctgggtacttgattgcttcgttttctttacctaataaaatgtccgcaatgtacaacgactcgaaggtagctgtcggcgttaaacgtggcgttgtttttgcgacgacatcaccactggcataaatgtgtgaaacgctagtctgcatgtaatcgtttacgactaccccgccccgattcgtttcaacatcgatgtcttcaagattcatatgatcgatatttggtatacgaccagttgtatcaaataccatcgcagcttcaaattgattaccttgcgcagtcgtcacaatgtatccgttgtcagttgctttgatttcgtttacagcattaccaaaagcaaagttgatacccttttctgacataatttcaacaacacgttgtgtgtattcagcatcgaaatttgccaaagcacgatcagcatattcgataattgtgacatcgctaccagccgcatgggcaatagaagcaaactccatcccaatgaacccggcgccaatcaaaatcatcgatgttggcatttcgggtaagtctagaaaatctttactgtcatacgttaattccgtaccagccactggtagcttagcagcacgttgacccattgcaagcacaaaattatcagctgtatatgtttcatcagcgacaacaaccgtgtgttcgtctacaaacgatgcgtgcccaaaaatgatatcaataccatcaacggccaaaatgcgtgccataacatcgtccattggatcaataacttggtgcttgtaggccatcaactctggccaaacaatgtttacagcgtcgttgataccaatgccgtgataattatgcaaatgatgcaataattcagccgggccatctaacaaaattttggcgttgcagccaaaattagtacacgttcccgacactttttcttgttcaatcaaggcaacctttttaccggcacgtgctagttcttgggcgccgtgccaggcggcgtgaccacttccaatataaattacgtcgtatgtcatgatttcaccttttctatatgcgtaccaaatatcgtacaagttaacgatatcactaacaaaaaatcaggtcaaaccaaacacaattggtagtatgtttttatttttagtagaaaaaagcccatacaggtatgtatgggcagaaagcgttatttttgggcagcaacccaatcgcgatattcgttatgcaacatccccatgaaataagaatcgtgatattgcccttcagcaaagaattgctcaatcaacgttccttctcgtcggaagcccagcttttcgtagatatgaatcgcagaggcgtttttaacgtcaacatacaggtatagcttgtgcaaatttaggttgttaaacccataacgtacaccataagccattgcctttgtcgcatacccattgcccgtaaaagcgctgttgatataaacctgaatctcggcagtccgatgtagcaaatcaatatccataatctcaacaacaccaactggcgtaccgtcgtcttcttggacaataaagcgtcgttcgctttgatccaagatgtgcttatcataaagcaggctgagttcatcgaatgacgaatacggttcttcaaaccacagtgccatggcattgcgcgtgttttcttgttggtaaataaactccaagtctactttttctagtggtcttattatcattggattcccctcgttaataacaattattgccattattataacgatgataattaacgctttgccactctcaaccactcaaaataaaaagtccaccatactggtggacttgaaatcttgcttatttagcggctggtgcaccggtcaccaggtcaaaaatctgattaaccagcgtgtagttttctttgctctgcgccgcattttcattgctcaaccaaatgaccattgttttaccgtccttggttgttttaacagaaggttcaaatcctagcaaaacgccgtgcaatcggtaggcattgccatcgtcgtacatgcctgatgcgtagttttcgtttggacctgtgaccaacatttggtgcaacaagtttttactaatcagcttaccagctagttcttcatgtaataacttgtacaaatttccggtcgtcatctcaatactaccggtaccgacttcgcggttaaaaatacttgggttatcaaagaacggcttcccgtcagcgccataattttcaacacgattaggactattgacgaaatcattataatttgtgtaatcgatgccgaattgctttttgaaagtattgtctagtagctgctcatatgacttgccggtcaccttgtgtaggatgccaaccaaggctacgtaattaccagctgaataataccaggcgccacgttgatccatggtcaggtgctttaaaccaaaatcaacgtagccagcttcatccagcttggcttcggttttaccaacctgattataaccagctgtcatgttcaacaactgctgaatagtgaccgtgtcggcgtcaggtaattctggcaagtattggctcactttgtcagtcaagtgtagcttaccagctgcaacctgctgcatgacaaggatggccgttagattcttctgaattgatgcgataccatacagagatttagcggttgttggcgtattggctgacttattcgctaaaccaaacccttgattaaggattattttgccattttgggcaaccaaaagtgtgccactgtgatgactatcctttgcccgctgcgcaatttgtgcccctagcgtaccagatggcgcgatagtttgattaacatcgacctttttaatcttttcatgcttcgtagttggtcgtttttcctgtgctactttatttggttcattcagaccaataaaagcccccaatgcgacaatgacaattaaaccaatgcctaagtgtagacgcttcatgttatccccctcatgactaatgcttatttatggtaaacccaagctggattttgcgtttggctagttttcgttgctaaattaaacccaagcggattacgcaacgccttatatggcaaagcgtacttattgaatgtttcgggatcgatatagacaatacgatccacgacggcctttgtcttaatacggtacaccggtgtcgcactctcaaataaggcgtagaagcggtctgtatccccgtcgtaattaacgccttccaaaaatggtggcatggtgacatacatgccattggtcattttgccgtcatcccccttatcaaagcgcaccaactttgaatcagcattactaaacgatgatgtaatcatcacgtgattcgtattagctgaaatgccctgcaactcaggcacgctttcataaaacttattcccggcaacgattgatgggtctttatcgcccactggttgtccaaccattaacgttgcgtttgaatccccgttaattgcaaacttttggatgttacttagaccggtacgcgtaaagtatccaacccaaagtgccccatcataataagccacagttgaggcattaatcgcagttttaagtgtgaaatcctgctgatagccaattggcagcttggaacgaatgtcatagctatcaatatccgtctgagcgatgccgtatagcacagaatctttaccgttgtgaccggcaacccagagtaattgatggtcaggatcgtatgaaatgccaccagcgtgatcttgatattgtaggactaatgtcttgatgtaacgaccagtccacttgttaagcacataaataactgaatttgctttgtgtgcgtgatcatacgcagagataaaaatttcattacgaccaactgcgatgacctgtggatccaatgtatcgaccttaatcagttggtgcttgtcaactgatgcttgccccgcttttagcgaccaggcgccctgaagaccaggtagcgcaattgcatattgcagatcgtcatgcatcaccggatatggtgacatacgatttaaaaaatctttatctgaatacagtggtttttgtgaggcacccccgtaaggcaccttcacatcatcgcttttaactgtatttaagtcggaactaatatgttgatgcgtcgtgagaccccaaaaaataaacgcccccatgattatgaggacgctaaaaatgatactgacgttttttcgcatatcccaaaacctactcactttttattaactcttatattatacaagaggaatgagattgcgttgattgctacggttttaagaacaccttttcttaaggtggtgtcagttatctttattttcatgtaattctttggcttcggcttgttgtaactcgcgtgcggttggtagctgcggacgacgtcgctttccgaccaacgtgattgaaaatgtgatgatgctcaataaaattaggccgattaacggtaatagtagtccatgcatagtgctacctccattgacgcgttattagttaagtctaagcataatgagtcccaacccaataagcaagtagataatgagtagcacaccattgattagcatcgcgcgtagtggaaagtgccatgattgatcgcttgtatgttgtgcaaattggcgccaagcgagtaagttggccaatgatgcaatcaacgtacccaacccaccagtcgttaccccgaggtacagtggcgaaacgtggctagtgaagtttgataacaacacggctgccggcacgttactaatgaattgacttgagattgctcctgtgatgaacgtcattgctggtgttgtcataccaagcttaatcatgtcggatacccattcaatgcggcttaatgcaccaacaatgataaagaactcaacgaacatcaacaagatgccataatcgatttggccaaaggtttggcggttgagtagcaatgctgtgacgatgctgaccaacaaggcaccccaaattggaaagagattcaaaatgccggctagtactaatagggtgctaattaccaagataatgacagttcgtgtctctatttttgtcgtagttagttcgatgtcatggatgggcacgtttttaaaggcaaacggactgagtaacaagaacactaagttaatcatgccgattggtagtgacagctgcaaaaaatgtcccagtgttaaatgataatgtgacgctagataaaggttttgcgggttaccgaacggcgtgaaggcactccctaagttcgcaaaaatcgtgataaagatgactggtaacaccatctttaattcaagtttgcgggcaattgtcacaaaaattggtaccaacgttagaatggccacgtcgttggtgaaaatcattgatccaaagaatgacagcaatagcgtcactaaaataacttggcgcgtcgtgcgactctttttaataatggtcgttgcgatggcaaccaagaccccagttcgctcatagacaccaactagtagcaataaagcggctaaggctacaatggtatgtacgttgatgtccgtccaagccacttggccaaaaagtaatgcaagaacgctcaagatagtcgtaatcgctaaagttttgtcagatagtatttttttgatgaatgtcggcataagacaccccacttttcttatagtcagagtattagtatacggcaaaaataaaagcagaccaactgccgtttggcaattaatctgcttatttttacgtgatttagttttgacgacgcttgcgtgattgcatgtagaagtacaaaggcaaaccagctagtgtcaaaattagcccaatcatggcgagttggaactctgaaatcaaggtcatgacaatgatgaatactccaccagcgataccaatgattggtacaactggatacaatggcaccttgtatggtcgtggcaaatcaggttcggtaatacgtaacttaataacggcaatgaataccaacgtatagaacagccagataacgaagatcaacatgtcggttaacatgtcgaaaccaccgataaacatcaaagcaactgccaagacaagttggaagataccagccacatatgggatttggtaacggttcaacttaaccaagtgctttgagaatggtaactcgttttctaaggccatggcatatggcaaacgcattccggtcatcgtgtatccgttcagcgtaccgtagatagaaatcaagataccaatcgtgatcaacttaccaccgaagccaccgaaaatgtgttgtgccacatcactagcggcgttttcgtttcctgagatagctgacaatggcaatgagtgcaagtaaacaaagttaacaagcaagtaaatgaccatgataccaatcaacccaccggcgattgcacgtggcaagtccttttgtgggttcttcatttcaccggcgatgttaccaacgtgaatccatccatcgtaggcatacatcgtggccaaaagtccggcaccgacagccgttgcccatgaaccggcttgtgaacctggttcaactgggaacaagctgacatccaccccacctggttgtagcaaaccaaagatgataatcaaggccaatgggattaacttgaagaacaacgtgattgattggaattgtccagcaatcttagatccaagcaagttaatcaaaaagactgatgcgaccgcgatgattcccgctggaataatcgcacttgttggcaagtggaacaaattagcaacttgggtaccgaagataaccccctttgccgccacactggctgggaagtacacaacaatttgtgcccaccctagtaagtaacttggtaacttaccataagctcgttcgatgtagactagcatcccaccagtttgtggcaatgcggcagcaagttcagcaccggtcaaaccggcagccagactaatcaaaccacccaaaatccaaacgaatagagacatactggttgaaccagttgattgtgcaacactagatgctttaaaaaagacacccgctccaataacagttcccatgacagtcgaaatggctggcaaaagcgtcattgtacgattcagtttgttttgatcgttcattggaagccccttatttaaaaatttcaataatgtctatcataccaggttctgctgtaaaaagataaggaatacgggacatatattagtaaaaaataaaaaacgcccgaaatttaattcgagcgtcagcaactaccttactttggcagagcgtaatttgctatttgtaaccgtttctagctgacgcaaagttgctgcatcaatgtgcaagccactcgcaatctgcccgaacgtccaagttggatgacgttcgcacaaatccagatagtgttcgatgagtttgtcattaatttttggttgaacgacttcagccaccccgttcactgcaaaatctgcagcgttggctttttcgaacgtgtaatgcaaggtgcttgggcccatttcaccagtagagtaatccatatctacatcccccgtgtttttataatagacgctttctttccttcatgagatttatattaacatttaattaactaattaaaaataaacaatcgacggtcatttccgaaaaaaacaaataatttcgtgtctatgttgacacagttttgttctcatggttgcaaaatgttacaatcagtaagatacatttttgggaatgttaggagaaataatgtcaacgagacaagatttaattcgcaattttgcaattattgcgcacatcgaccacggtaagtctactttggccgatcgtattatggaaatgacaaacacagtatcagagcgtgaaaccgaagctcaactgcttgatgatttgagcgttgaaaaggctcacggtgttacggttaagtctcgtactgtgcgaaactactacattgataacaacgggactgaatatcaatataacttgattgatacgccaggccacgtcgactttaactatgaagtctcacgctcattgtcagcgactgatggtgtgttgcttctggtcgacgcgactaagggtgtgcaagcccaaacggttgctaactaccgtcttgctaaggctgctaaccttgtgattattccaatcgtgaacaagattgataacatggctgctgaagttgataagactatcgaagaattgcttgatttggatgagtcatttaaggaagaagacatcctaaaaatctcagccaagagcggtttgggtgttgatgcagtcctagaggcaattcgtgaccgcatccctgccccacaaggcgacgaaactggtaagttgaaggccttggtctttgattcgaagtttgacccatacaagggtgtcattgtgcaagtacgtttgtttgatgggcaattgaagtcttcagacaacgtgttgttcatggctaacaagattaagtcgcaaatcaaagaaatgggtgtcttctcacctttgatgacgccacttgatacgcttaaggctggggatgttgggttcattgtgactggtattaaggatgccaaggcggttcgtgtcggtgatacgattacacttgctaacgatccggttgctgaaccccttcctggttatcaagatgttgagccaatggtttatgccggtctttaccctcgcggtagtgattttaaggacttgaagattggtatcgaaaagcttggcttgaatgatgccgccttccaatatgagccagagcaatctgaagctttggggatgggattccgtggtggattcttgggaatcttccacttgcaaattattcgtgagcgtttgcaagaagagttcggcctggatgttttgacaacgatgccaaattcaacgtaccgcgtaacggtcaagaatgaagatgagccgatttacgttgaaaacccaattcaattccctgattacggtcaaattgtaaaggttgaagagccttacatgttggctaagatgacgttgccaaacgaaatgttgaatgacattatgcgcttggctgaaggtcgtcgtggtgaattggtggatttggcaacgattggttcaatgttgatggtgacttaccgtatgccaatttcagaaatcgcctatgacttctttaacgaattgaagtcagcgtcacacggttttgctaccctttccacagagtttgattcataccaagagtcagacttggtccgtatcgacattgcggttgattacgctaaggttgatgcgttgacattcgttatgcaccgttcaaaggttgatcgtgttggaactgaaattgtttctaagttgaaagatttgattccacgtaagttgcaatcaatgccagttcaagccatcgttgaaggtcgtgccatcgcccgtgctgatgtgccaccactacgtaaggcagctgcttctggaaccaaggtatcaaagaagcaacaacaattgcgccgtcaaggtcaaaagaagagcgacatcgaattgccacaagcagtctttgacgcgatcctagacatgaatagtaattaataagatgaatccccggacaactcgatctaaagttgcgtccgggggttcattgctttctcttgcttagagtatatatttacttgaagaacgtcttgatttccataccacatttttttacactaggcttattcacgtccagattggaatgacgtaaaaagctatgggagtatttttatgggaccagaaagtaagtttggccgtcaatctttttttgatggtgggttgctgtcgttaattggttggagcattttggggtttattgttacggtcatctcacttggaattctatatccgtgggcattggtgatggtatatggttggaagattaaccacactgttattgacggtcaccgcatgcagtttaacggatctgcagtgggcctatttggtaactggattaagtggctgttactgatgattattacgctaggtatttatggcttctgggttggtatcaaattggaagattggaaagccaagaacacgcgttttttgaattagtctcagatatgacaattcaaaaaattgctatataatagtggcatgaataatctacaaacgattcgtgagttctttcaattaggaaccactgaagtaagcactgcactacaactgtcaccagatgaattacgcgcctatgaatcaggtgaaaagcaacctgaaatcttgatgtggcaacgtttttctgaatattacgcggataaattccacgtaccagccctacctgacatggttgagccaatccacttccgtcttagtgtggactacttgatgaatatcggactaacgatgaacgatttgatggcgtttaagtggtacttcgataacacgcgtccagaaatcggcgagttcacgattgccttgtatgaaccaggtacaaccaagattgaacgtcgcacgactgacttgccggctgttcttgatgaatacgctggttacatcttgttaaacaatgatgggtcacttaaccaatttatcgatgaacgtaataacgacaagattagcgattggcgcttgttattgtacaaaaacgacaatttcatggttgatgttacaccggatttgatgtatttcgaatacctggtaaacatgaccgttatgtagaaaaaaggagatctcgtatgaggtctcctttttggcatgctatttaattgtccaaccaccatcaatggtaaacacttgcccttgcacataacttgattctggacttgtgagatatagcgtcatatcagcaacttcttgcgcagctgcccagcgtttaaccggggtttcagcagcgacctgcttggccattgcgccgtcaccagcgaaatcagccgcgttcattggtgtgttgatggcaccgggtgcgatagcgttaatatggacgccttgatcagcataatctaaagctaattgtttcatccagccgactaaggcgtgctttgacatcgtgtaggccgccccgccaccgccagcaatttgaccggcgattgaggccatgaacaccatttgtccagcttggcgtttcaccatatgtggtaagatagccaaacttacttggacagccgcgttaacattgacgttcatcaattgttgaatggctgtaaaatcggtgtctaaggccggtgtgaatgcatctaatacaccagcggtgctgagaaagatatcaacgatgcttagttcgtcattatgcgacgcaatccactcgcctagctgggtcatatcacttaaatctagttgatatggtgtcaaacgatcgtgcgtaacgggtattggttgcttatcaattgcgatgaccgtcgcgccggcatctaaataggtgtttaactgggccaatccaatccctgatgcagccccagttaacaaaatggtttgttttttatagtcttgtgtaatcattacttttccaaatcaacgcgcttgctcaaaatgtagaagataacagccccgataatcaaagctgccagctccccaagcgccgtccaagcaaatgttgcccagaatggcgtcttggccataaagtacaactcggcggcaacaacccacatcattaatgcatcgataacggtactaatagccaaacgcttaatcacgcttttaaccttgcgcgtcgcaaagtaagacatcgtggtcatggctaaggtgccagccgtaccgacaatcatgtcgacgattccgtatggtgaccagatattggcaataaataccccgatggtcaaagcgatgatgtaacgcttgttgaagacgaccaaatggttaaagccttctgaaaagcgtagttggaatgggccgtacgaagcaaatggcaaagccacggttgcgacagcgtacaatgctgcgataacggcaattagtgaaatatcacgcgctgaaaaagagcgttttttcgtgtccatatttaattctctcctagtttttttgagtgggatggttacgaaccactaacttacagcatagcaaaatcactccttatcggcaataagcgtttttcaggacgaccttgtcaaaatcctcccagttatggtagtttggaaaaatacttattttttccacggaggatttttgatgaaacgcttttttgaacgatcatttattttgggaattgtcacaacgttgatgatggtgacaattattagtatttggaacggtacttgggttgcaggttggcatgagaaaacaattcttgcgacactaaccattgtaccgttgactttcatgctagcgttcttactgaaggaaaacgtaaccttgccattggtcattaagctccacgatgtcttgccagcttggtttagtcgtctaattccacgtcgtcattcgatggcggtgttcattgtcaccggtaacgtttcaatcatgtcattttatgggctgtatatgtctcaccattacgacacgcaccatttgattcattcttactttatccaatgggctcacacgctactattcgcaattccgctattgcttttcgtggttcggccacttgtgaatggcgtattcgaccttgtttggcaccaagaagatgcagcttaaatcgtagtaacgacagaatataactgctaaagcctgattgtcctaaaaatcaggcttttttagttctaaaaattagatttatatgtgaacttttggtaagctgttactcgtacatgtacgaggaggtcacatgaaaaattcaaaaaaggccaagaaaatcgggttattccagcttgttatgctgggacttggttctctaattgggtcaggttggctatttggtgcttgggaagcttctcaagttgcaggtccagccgctatcatatcctgggtaattggcggtatcgttatcggaacaatcgcctataactatattgagcttggtacgatgttcccacaatctggtgggatgagtaaatacgcacagtatacccacggttcattactcggattcattgcttcatgggcgaactggatttctttaattacgttgattccaattgagtcagttgcggctgttcagtatatgagttcatggccttggtcatgggcgaaatggacgcagagcttcatggcaaatggttcaattacatctgaaggattattagcagttttctttttcatcgctgtgttcacgttgttgaattactggtcagtggagctattaacgaactttacgagcttaatctcagtatttaaaattggggtgccgttgctaacgatcatcatgttgacgatgtcaggttttcacccagaaaactacgggacatcgttacacgagtttatgccgtacggtacggccccaatctttgcagccacgacggtttcggggattattttctcatttaacgcctttcaaacagttatcaacatgggaagtgaaatcgaaaatcccaagcgaaatatcggtcgcggtatcgtttattcactactaattagtggtgtattgtatattttgcttcaaagcactttcatcacagctttgaagccggacatgattgcagctagcggttggcacggcataaactttgcatcaccgtttgctgacttggcaattttgcttggtattcattggctgtcagtgttgctgtatatggacgccttcgtttcaccgtttggtactggtgtatcattcgtagcgtcgtctagtcgtacattggcggccatggtttctaataaccatattccaaaattcgtcggtaagattaacgaaaaatacggtacgccccgtatcgcaatggtggttaatgccattctaagtatgctgatggtgtctattttccgttcatggggaacgttggctagtgttatctcaacgtcaacattgattgcctacctaaccggccctgtcacagttatttcattacgcgaaatggcacctgaattcaaccgcccattccgcggtaagattctaaaggttatggcgccactatcatttgttttggcgtcgctagcgacttactgggcgatgtggcccacgacagttcaggttattttagttatcttgctcggattgcccttctacttttactacgagtggcgcactggtttcaacaagacgaaacgtgcgtttgagggtagtttctggatgattggctatttgatttttatctcaatcatgtcatacatcggatcgaaggaatttaacggtcaaaattggattcattatccatttgatttcattgtcattattgctggctcactgttgttctattattggggaactgttagtcacgtgatgaccaaatactttaagcaagcgcaacgcgttaatgcgaaagtgaaagttaaaaagtaactgaaaaatgccggatgattcaagtcatccggcattttttaatgtgagttttatttttaatattaagcgcgccacttggtcaagtactcgttagcggcttcaacgtcaggcacacgcaaacgttggccagtcattgactcagtgttctcaaagtgcaacgcaccgattagttcaccaaccatctttgacgtcacgtaactatccttgcggtacaaagatggacgaacacgagtgttaactgggccaagaatcaatgagttaacgttaaatcgaccggccatttcaacagcgtaaagctcactcatcatgagaacagctgcgccagctggggcaactggacctgggaacttactgaaagcagcgtcttctgcggaaacgccactaataaacgtgtagtttgcaccttggcggagcaaaggcatcaaggtcttgctggcaacaaagtgagccgtcaacaaaccttgcatcaactcttcccattcagccttagtaatgtcagtcaaggcagcgccttgccaccaaccaccaagtgatgacaccattccgtctagttgttcgaagttatcaacaatcacatcgtgcatcttttgtgcgtcatcttcgtttgaaatatcaccgaacaagtaaaacacgttcttacggaatggttgatcaacaaaccctaatgcatccaacgctttttcttcagaacgtgatggcactagtacggttgcgccattctctgctaaatacttgacgattccctcaccaacggccccggttccaccggcgaccaaaataactttaccctcgtacatattgtttgcctcttgtttcgttaattcgtatggctatcatacctagtttcggcgcgcgggtgttgcaaaaagggaacatttttaaatgaatgaacgcttatttatcagtgtattcgcggatgacctgcaagatgtcagcacgggcgtcgttgacatggacgctttcacgggctagcagatagatgtcaaacgttggtacgtcgtcatttaataacttgataaagtgcatgtcacgatcagtttcttgtaaggctaacgtcgtaattaatgtcatcccaagtccttccttcactacccctttcaaagcctcgacgtttgaagttgtgtagagaatgcgtggaaacgtttcggtgttatttgtgagttctttaaacacgcgactatgaatgaagccttcgtttaatagaatgaaatcttcatcagcaacatcttcaaagtacatttcatcaggtaaatctttgtttgttgttgcgagtacaaatgggaaggatgcgaccttttgggcaataacgccaggaatgtgaacctgatcaatcgaggcgattaaaccaaaatttagtttaccgtccgcgatttgcgccattaaatccgcactacccatttcgaccgcttcgaaattaggcagcaaatgacgtttagctaactgacgggttaccggcataaaatagtaagttccgataattggcggtaaaccaaaccgtaattttttcaaggaatgcagacggacttcttccttagtgaacgcaatttcactttggatttgcttggctagttccaaaactagttccccagtacgcgtcagttcaactgatttctttgaagcgtggcgctccaacaattcactgtcgaattcttcttctaatcgtttgattgcgtacgtgatggttggctgtgtgacaccaaactgctctgatacagctgtgaactgctttaactccgcaagggcagagaagtaagacaagtctttaaagttcattgcgacgccccttctttcgttaatataaattaattttatcatatctgtttaatttgactataaaaatttataggtagtagactgggcaccgttaagaaattatttatagatttaagggagatgtttacaccatgcgtggacaagaaattttaaacaaccccttcttgaataagggtactgcctttactgaggaagagcgtgcagaacttggtttgactggtatgttgccagcccatgttcaaacgattcaagagcaagctgatcaagcttatgcccaatacctaacgaaggttaacgacgttgaaaagcgtattttcctttcaacgttgttcgacacgaaccgcacattgttctactacttggtagatcaacacgttgctgagttcatgccagttgtctacgacccaacaatcgcagacacgattgaaaactactcagcattgtttgtgaacccacaaaacgctgcgttcttggacatcaaccacccagagaacatcgaggccacgttgaagaacgctgctgatggtcgtgacattaagttgttggttgccactgatgctgaaggtatcttgggaatcggtgactggggtgtccaaggtgttgatatcgctgttggtaagttgatggtttacacggctgccgctggtatcgaccctgcttcagttttgccagtttctgttgatgctggtacgaaccgcaaggaattgttggaagacccactatacttgggaaaccgtcacgaacgtgttcgtggtgaccaatacttcgagttcattgataagtttgttaagacggcgcaatcattgttcccagagatgtacttgcactttgaagacttcggtcgttcaacggcaacggagattttgaacacgtacaagaatgactggccaacgtttaacgatgacattcaaggtactggaatcgttgtaacgtcagctgttttgggtgccttggctattactggtgaagacatcaagtcacaaacgtacttgacgtacggtggtggttcagctggtacgggtattgctaaccgtgtcttggctgagtttatgcaacaaggtttgtcagaagaagaagctcgcaagcacttctacatggttgaccgtcaaggattgttgttcgacgatgacgaaacgttgacgcctgagcaaaagccattcgcccgttcacgttcagaatttgagaacgctgacgagttgacggacttgttgtcagttgttaaggctgttaagccaacggttttggttggtacatcaactaaccctggttcatttaccaaggaagtcgttgaagcaatggttgccaacacggatcacccaaagatcttcccgttgtcaaaccctacgaagttgcacgaagcaatgccagatgatttgatcaagtggtcagatggtaaggcattggttgcaactggtgtgcctgttgaccctgttacggcttcaaacggcgtaacgtacgaaatcggacaagctaacaacatgttggtttaccctggtttgggattgggtacgattgttgccaaggctaaggtcttgtcagatggtatgatttcagctgctgcccacgctttgggtggtatggtcgatgcctcacaacctggtgcccctgttttgccacctgtttcacgtttgtcagaaatgtcattccgtgttgcggttgccgtggctaagcaagcgattgctgaaggattgaatcaagttgaaattgacgacgttgaagctgctgttaaggctgctcaatggacgcctgaatactaatcgaatataggagatatttgggaaatgtctgcattgctaacttcaatctcatctgttgttgagattatcttcgtgattgctttgggttacttcctccgcaacggtggtaagttccaagactcattcaagcacgatatcgaattcttgatcatgaaggttgcgttgcctttgaacatcttcgttggtgttttggacaacttgacccgttcaaagttgatttcactttctggttcattgatctttgtgattatttctttttcctttggttacctagtagcttggcttttgacaaagattatgaaggtgcctgccggtcgtcgtggaacgttcattaacatgttcgttaatgccaacacgattttcattggtttgcctttgaacttggcattgtttggtgaacactcattgtcattcttcttggtttactacttggctaacacggtttcaacgtgggccatcggtatcttcttcatccaaaacgacggtcctaaggtcgctgacaagaagttcaactggaagaagttgttgcctgccccattgctaggatttatcgtggctttggtatggttgttgctagatttgcctttgcctacgttggttgataagacgttctcaatggttggtggtgtcgtaacgccattgtcattgatctacattggtattgtcttggctgacgctggtttgaagtcaatccacttcgatcgcgacacaatcgttgctttgcttggtcgtttcgtcttcgctcctgccgttatgattgttatcatgatgatgtttaagggtgcgatggacattccatcagttgagcaaggtactttgataatccaagctgctgcccctggattggctgtgttgcctatcttggtcggtgaagctaagggtgacgttgaatacgcaacaaacgttgtgacgacgtctactgtcctattcgtgattgttgtgccaatcttgatgcaaatcatcacgatgttgtaattaaatacttagggatgtggcctgtgcgcaaacgaacatgcagaacacttttactaaactagtgcatgtcacatcacctatcaaaaagacctcggaattttggttccgaggtctttttagttatttcaaaattttcacagtcaagcctaacatgaccgcaaccaagatgaagccaattagtggcatggttgttgcccccgctgcttgataaacccaaccagtgattagcggtaagaccaccatcccagcttggcaaaaagctagattgcgactaaccatcaacttggccgtttgatcatcgtgtcgttcatacggcaccatcatcatcaatggatagagcgctgagaggcccaaaccaatcgcgaaactagagcatagtagcacagcggtgtttggtacaaatagtagccccatcccaccgaacgtcagtacgatatgccctaaaatcaattgcttgtttgagaaccatttcgtcgtcaacccagttaggaaacggccgaccattaagccggcccaaaatagtgtggtggcattcgctgctaatgagtcagatagtttcaagcgatcgactgcataactagaagtacttacccacaaccaattcaaccgaatagaagaaatagaagattggtaatagccagtcagctccccttaatttgccaccagtctcagttgctgtatcagaaccattatctttttctgcaaattcttgtcgtgtttgataaacaaacagcataatcaacagttgcaagacaccaatgattaggacaccgatgcgccagccagttgggaacaatagactaatggcgaggataagcgaactcaacgtgacaccgacaccatacatgccgtgcaaaatgctcatcaagccacttgtaaagtgcttggcggcgtagtcgtttacagcgatatcaattgccccttgtcctaagccgagcgctacagaagctaaaataagcaggattgtggcctctccccatagcaacagcaaaataccaatcatgacaaatcccatactcatgagcatgattgatgccatcgtcattgcttttgcaagtctaggataaagcaacgtcgatatgaaggagaatgccaggctaatcattgtcaaatacccaacgtagtcaacgttcacgtggtatgtttgacggacagccggccaagcactacccataatggcatctggcaaaccaagcccgatatagattaaaaagttcaccagaataatgaacgttccgattttaactggttttgtcatgagtcgctcctaagtgtgttaatcatcgttagtttacgataaaactatgcccaaaatatgaaaacacgagacctgaccccagatctcgtgttaatacgtgcactattacaattgaccccatgcagatgatgaaattgatgggaaaaggtaaaccattcgctcaatttcagcaggaccaaacttaaattcaattgctggcaacaaggtgttaatcacatcgtcggccttgtttgacacttcagtcgcaccaactaacttgtgagccttgtcgaagattaagatattgtcgccgattgtctccttgtcaacttggcggtaccaatcatcaggaatgtggttcgtttcaatcgtgtacaactcaggattagcttccgcttcagcaacggtgacacccacctgagccaaacgtggtgatgtgaagacaacagatgggattgctggataaacaatcggttcagtcgtttcaccggcaaatgtgtgcatcaagtagagtgattcaaagacagccgttggcgttagctttggttgcaccttatcaatcacatccccagacgcatagatatttgatactgatgtccgcaggtaatcatctaccgtgataccagccggtgtgtaattaacacccacttcttctaaaccaagattctcgacatttggtacacgaccagttgcgtcaagcacccaatcagtttcgatgttcaagtcttgtccacgaacaaccaagccttctgccccttggacaattgcttcaacggcagtttcgcgaataaaggtcacaccgtgcttttccaaatcagcgatgatttgttcaacgaatggttggtgataagccttcaatgcttccttgccacgcaaaatgaccgtcacatctgaaccggctgcatttgccatcgtggcgaactccatagcgatgtaaccaccaccaatgattgttagtcgttcaggcatgtcagtcaaattcaaaaagtcctctgaatcgtgtgccaagtctgaaccaggaattgtcaaacggtgtggacgaagcccagttgaaataacaatcttatccgcagtcttcgcttcgccgttcaccatcaccgtgtgggcatcagccaacgtaccacgaccaaacagaacatcaacattagttgagtccatcaaaccttggatgaatgctggcaagccatcaatcacctcatgcttgtgggcttggttttcagcccaatcaattttagtttcgccgttaacaataccgtgcacttcttccaagtgacgttgcattgcaactggtgaatctaagacaattttcgcgttgcaaccgcgatttgggcaggtaccgccgaccaaatcttgttcaacaacgccaacctttttccctttcgctcccaatggaattgcaccatcaaacgttccgtgtcctgatccaatgtacagcacatcgtaatcgtagtttgccatgattctgcctcctaaagggtgtgtatgcgattttcagtattccgtgtctctcacctacggaacacatctattgtatctaaaatgtaagtgaattgcatattatctgcttgttctttagaagtttttggcaaatgacgcaaaaaagcacctcagatgggccatcagaggtgctgaaagttacttaaacaacgcacgggttgcaagttggataagtgtattaagttcatcttcactaacgctcagattattacgcagacgtgactgcatgagccattgcattggctgcaaggcctgggctacgatgatatccacgttggcagtggttagcagttgttgctgatacgcttgcttgataaccgttaacatagcaggactcaacaatgacccttcgccttgcatatcgtcaggcaaaaattcaggattggcgaccatcgtggccatgaaagcaacttgttttggatgcttctcgaaattagccgcgtaatcacgcatcaatgttgcaaactgatcttgaggcgtgagcgtttgatctggcattggtagttgcgtgattaaattttcttgtactttactgaatagttggcccaataaatcagccttgttttcataataaatataggtggtcgcaaccgatacgccggcgcgttttgctagtttattgatgcttaaattcgcaattcctgattcttccactaaatcaaacgttgcgttttctaaagcttgaatcttattctcatctcgtgttcgcatacattattccctatcaattgctaaaatcgttactccccagtaaatcgatgctcagcacagtcttttctatctcttaatcgtaacggttatgacgcaaatgagcaacaataaaaaaagaggggcgctcccctctttctctcgctatcctttaccggtggttagcttcaagccaactgctccgacgataatcatcgtgataaatagaatgcgcttccaatctttagactctttgtacaaatacatgccgacgatagtgccaccggccgcaccgatacctgtccagattgcataaccggttcccattggaatctgacgcaaagccagacccaacaagccaatgcttaacgcaccgccaatagccataccagctgcagcccaccaagctttacgtcgttgccattcgttaatcatgataacgccagaaacttccattaaaccggcgagaacaagaaatacccatgccattatgtgtgttcctccgtgatcaacttaagtgcaattacaccacctaataagatggctaagaaaagcaactctggtaggtctaacttgtccccaaagactagccaaccagtcaagacagttgcagcagaaccgagtccgacgaatacggcatacacggtaccaacgggcaacttgtcgacagcggtcatgaacaaaagaaatgataaccctaaggcaattagggttagtccccattcccaccattggttggcgtgttttagaccgacgacccaaccatcttcaaagccaatggctagcacgatttttaaccaaggattcctcaacatacgaggtcctcccttactttaattctgtttaactattccagtatacccaaaagcaactagaaagtgtgttaatcagtccgtattagatagttttccgtcgacaattttgtagacgttatcagaaaactctcgcagacgatcatcgtgcgtgacgatgacgactgctttttcctcgtcatgcgcaatattggcaaaaagttggccaacttctttgacacgcgccgtatccaaggccgccgtaggttcatcggctaggatgattgccgggtctgtatacaatgctctggcaatcgcaacgcgttgttgttgcccgccagacaattcgccggggtatttgtttaataatttttgaatgcctagcgtttcaataattttgtcaaaggcatcttgactgaggttattgttaggcttcacctggtctacaagtttgaattggtccgctacggttaaatatggcacgagattgtatgcctgtaagacgaacccgatttgttcaagtcgtattttttcggcttctttggtactcaaatcactgatatcgtgaccattcaaacgaactgagccgtctgttggtgtctgtaacccacctaaaatggttagcaaggtacttttaccagatcctgaaggcccaatgataagcgacacctcaccagctttaaacgctaaactgacgtcttcaagtgccgtaactaaattggttttctgaccaaattgtttcgtcacgtgttcaagggctagtttttcttcacgcatctttttaacctccaattactgataccggatcaatcttactaatcacacgaatcggaatgattgcacccagtaagccggttaccatcaatccggccgcaatgagtcccatcaatccccaatcaaatgccattggtacgctatccggaatcccaaattcagttaatgccgatagtacggccccaacgacgataccagttgccataataaagaacgtctcaaataacgtattttgggccaagaaacgatttggaatgccttgtgcacgcaaaactgccaagttaggcaatttttgaaccgttagaatgtagaggaagattgtaatcacaatcaatgaaatgacaatcaggaagccaatcatgagaccaaacgtcgctttttgcggtgtataacctggcaatttattgataaaggcttggtatgaataagtctttaatgctttgtcatcgaccgattgtgacgtttttgaagcaacgacgctaccttggaattgatctgacacgcccttaatgacacgccattgcgctaactcaccataaataacaggtgcggtattatacgtggcatttttcacataacccacgattttatatttcgtatcagataacccaatcgaaattttatcccccataccgtaaatatccttatcaactgagtcagcgaggacgacttcgttagctgcctttggcaagtgccccttggttaattgtaggtttttagcgatgtactcgtcgttattcatcccaacgaattgggcggattcacgttttccgccaactttcatattaactggtgtaatgccaagtgttgcggttttttcgccacttaactgatcaacctgtttcgttgtcagtaatgactgtccggcattgccatttgcgtctttggtcattacaaaggacttagactgccagctgtccaccgcagcggtgttagctgtcgccagcccaagtgccagggcacttaaaatgaaaatcaaataactgattaagacgacgactgtcagaatcaagccgtaccgtagtttttcttttttaatctctctaattgctaaaaacatttgtccctcctgtatttgttgcagttcagcaaacttactatacacaagtatacaaatgtggattgactaattaatcagcaaaagaaaaagacttcccacttgaacaaatggaaagtctgatatctatattaatcgatgtgcgtacgtgaataacgggccattgctgtgaaaagacctgcgacggcaccgacaacaaccatagcgccttcgacaatacgcttcgtggtattatgcgctattgttgataccttggcatcaaacgtcttaggttgatcgggtgtcgtttcaactgttgcaagttgctttgcttgtgtactagcttcatcacgtgttgcacgagctgtttgactcgtcgtcgtatgtgatgatgtttcggatgctgacgacgcggtacttgcttcaggtgaggcgctagcagcgctacttgctggtgcagctgagctagcagcttgtgatgtctgttgaccatcaaatgccggattgtcgatttcacgaccatgactggccaagtctgccttcagcgcctggtaatcatgcgcttgcccaccaagatgaccgtttgatggtgccatcaaggttgaagctgggtcatgatccaaccccaatgagtgacccagttcgtgcgtgataaccgtttgcaaatctgccccttgctcagtaatgcgttgctgataaatatcagtttcgccagttggtgcaaaggtcaatgccaaattaggtgtgttgtcaccatctggcacaggtacatccttgattgttactgaagcggcacttggatcggttgtgacaccaaccacagttgtgccagccaagttattccagtaagctgctgcgttagcgacctggtttggatagtcgggcgaataagccacgaccatgttactgctgttcaaattacttgttgcccatgtaaccgcatgagctgatggtgtgtccgctaaaagtgcagcggtaactgccacaccgagcagtccttttgaaaaattcatgattcatatccctaccatttttaactcactgtataagttacgccttaccaattgtaagttaaagccaatagttttatgtaagcgtttttgttatcaaactgaaaagtcaatgaaaaaaactcccaatgttgccatctgggagttttaaaaatatgaattacttggttgctagggcatctgaaactttgtgaataatgaccttcacttcttgttgcaggcggccactttggccagttgtttttgtttgctctggcaatgattcaacagtcgctgtggttggggatgccttgacggacgttgcatcgcgggtcaccgtagctgaaccagcaatttgacttgacgttccagcatccgcactggttgatgtgtccgtatcaggttgcttttgctccgaaacggctgctgtttcagttgacgtcgctttttgacttgatgctggggtcgttacagatgagctggcttgacttgatgcacctgaattcgttgcctcgtaagctgggttatctaattgacgaccgtggctggctaagtctgccttcaaagcttgataatcatgtgcttgcccacccaattgaccaccggctggcgccatcaaagttgaaccagcatcgtggtccaatcccaaatagtgacctaattcgtgggtaatgacggtttgtaaatcaacgccttgtgaagcgatgcgtgacggataaatatcagtaatcccatttggtgcataagttagcgccacgtttggatcggcgtctccagctggggtatccttcttttcgattgtgaccgttgcatcagcctgattattcgtaacggcaactacggttgttcctgcgaggctgttccaataagctactgcagctgcagtttgcgctggataatcagctgaatacgcaacaaccgtttctgatgcgtttagattgctgtatgcccatgtggctgcatcaacgatggttgtattaactagcaatgctgtagccgtaataataccggctagtcctttaataaacttcattatgtctcactcaccttgtgtctctaatttggcgtctgcagtcgccttttcgatctcttgcttgactagcataaaggttactttgggtaagtgaaatgatatcgttttatgaaagcgtttttgttacacaattgtaaaaaagcgttcgcgacaaaaaatgtcgcaaacgcttaaagatttttaattttcgcgggctgtcatgtaagctcggctcattggcaacccttggccggcagcgcccttagtcattaggaactggataacgtcaatgtttcctgattcaaatgaagcagcactaccttgtaggtataagtcccaagcacgggcgaatgcttcgccacgctcggcaactgttttgtcgtatacggcgtggtaattctcagtccaagtttccaacgtcttttggtagtgtcgacgcaatggttcgatatcgtccaactgcataccggcttccataatgtgtgtgacgttctcggcgatgtttggaatgtaaccaccagggaaaatgtacttttggataaatggatcaacaccggcaccgtagtgttgaccagtgataccgtgaatcaacgcacgaccatttggtacgagatagttcgcgacgtccttaaagtactcgcccaagttttccttaccaacgtgttcaaacatcccaactgaagtgatgtagtcaaaggtcatatccacatcacggtaatcgcgcaacataacgtggaccttatcttgtaggcctagttcttgaatgcgttggttcgtaaaggcatattgttcttctgacaacgttacgccgtatgtttcaagaccgtattcttgggcagtcgtgataattaacgttccccatccagaaccgatatccaatagcttcttacctggttcactgtgcaacttgtctaaaatatggtgaaccttagccatctgagcttcttccaatgtcatcccatcctttggccagtacgccgcagaataagtcattgatgggtccaaccactccttatagaagtcattaccaatatcatagtgactgtgaatgtcttctttagattcattcttatcgtggccatggagcattttcgtcaacgtgcccttgaaaccgctttgatcagtcaaaaaactaccggattgacggtaggcggaagcaatcaattcttgaatgctgccttcaatttcaatgccacgattcatgtacgcctcagcgagtgtcaatgttggcatcttggctaaggacttcatgtttggtttctcattcaacttgatgtgaatttttggcaagccgtccccgtaattttctgacttaccatcccaatatgtcaccataacgggcacatcaaaagcttttgacaaaagcttgctaaatacttgtttctctaacatgttatccaccctatctcaataatcttacatattaaagtttacacccttttcaaacaccgaccaaaataaagggcctgtaaactgctgtttacaggccctttttagtgacttaaatttttagatttctgaaataacaatcttgttgtcaacaaggtctgcttgcaagttcttagcgtccaagtgatccaagtagaagtcggtcacgttgtcacggatttgttgctcgataacacgacgcaatggacgtgctcccatggcctcgtcgtagccttcatcgatcaaccaagccttggctgcaggcgtaaccgtcaacacaatgtccttcttagccaatgtatcgttaacatcgttcaacatcaagtcaacgatttggttcaagtcttccttagtcaaatgtgagaactcgacgatagcattgaaacggttcaagaattctggacggaagtatggtgccaacttctccatcaattccttgtccttagcatcatcgcccatcaaagcttcgttaccaaagccggcgtttgacgttgcaatgacaacagtgttcttgaagttaaccgtgtttccttgtccgtcagtcaaacgaccatcgtccatcacttgcaacaacaaggtcaaaacttgtgggtgcgccttttcaatctcatctagcaagacgatagcgtatggttggcgacgaacacgctcagtcaacgtattgctgttatcatcgtagccgacgtatccagcagttgcaccaatcaactttgaaacggccgtcaaatctgagtattctgacatgtccaaacggataacgtgatcctttgacccaaacatatccaaagccaattgctttgccaactcagtcttacctgttccagtaggtccgacgaacaagaagctaccaattggacggttgccttcatcgaagccggcacggttacgacggatggcacgtgatacggcttcaacggcatcgtcttgaccaatgaccttaccacgcaaacgctcgttaatacccttcaaacgttcaatgtctgaggcacccatttgtgcaactggcacaccagtcaaacgctcaacagattcagccacgtcgttaaccgtagccgttaccttcttagcctcgccggcgtcgtcgatttgcttttgcaattcgtcaatcttaaccttgtgttgggcagctgactcgtaatcctccttatcagcagctagttgttgcgcttcacgctcgcgcttgatttgctcttccaatgacacaacgtcagtgacaggattcttagctgccaagtgagccgccgtcatatccaacaagtcgatggccttatcaggcaaagaacgttgtggaatgtattggattgagtaatcaaccgctgccttcaaaacattgtcaggcaattcaacgttgtggtgttgcgcgtacaagtcacgcaaaccaagcaagatgttaaaggcatcctctggtgaaggtgcgttcaccgttacctcattgaaacgacgtgccaaagcagcgttcttcaaaatcgtgttacggtactcatcttgtgtcgttgcaccgataaccgtgaactcaccacgactcaaagcgggcttcaaaatatctgccaagccctttgatcctgagtcaccacccatggcaccggtaccaaggatttggtgaatctcatcgaagaagatgatgacattgccggcttccttgacttccttaatcaagttttgcacgttctcttcgaatgaaccacggtattgtgtaccggcttcgatgcttgaaagatcaattgagataacttccttgttacgaattgaagcgggtacatcaccagccacaattgcttgcgccaaaccttcgacaaccgccgtcttaccaacaccagcgtctccaacgaggactgggttgttctttgtacgacggctcaaaatttcggccgtctcttgaatttccttgttacgaccgataactggatccaacaaaccttcacgggcctcttgcgtcaagttacgaccaagcttggctagaatgccatccttctttggtgcttgaccatttgcctcgacttctggcaagtcttggttagcactgttaggtagttgacccgtacgacggtattctgcgaattcttcaggcgttacttcgcgtccgttgatcaaataacgagaattctctgagttgaaaccacccatgcgtcccatcatttggttaaagatatcatccatgttgttaaaatcattaaagtttgccattttatttacaatcccccaatattcaattgttaaactcggttgtaatgaggaggcccccacggccatccctcaaccttgtaatctaattgtacaactattacaaaaccattgcaagcattttctagcactctcttcgttagagtgttaattatttagagtgcccgcagtaaaaccgcgtcatacaggcgttttagtgatgaaaataaattaaaaaagctggcattaacgtcgttaaatcgttaatgccagctttttattctaaaacttaaagaatgatttcttaggacgagcgaacgagaatccctcgcctaatgtttcttgtgtatccatgaccgtcacgaatgcacgtggatcaatatcatcaataatctttcgcaccacattcatttccgacggatcaaccactgcgtagacaactcgttgttcattgtgcgtaaagccaccttcagcgtgcagcaatgacgtgccacgttccaaatcttgcataattgcatgcgaaatctcttccggctttgatgtgaagattaggaatgcacgagctgcataagatcccttttgggtgaagttaaccatttgcgcaaacacaaaggctgcaataacggtatacatcatttgaacaacgtcaatataaactagtgaagccgtcaaaactacgacgtccagtgcgaatagcgtacgccccatggggatgtttaacttctgttctaagatacgggcaatgacgtccgtcccaccagtcgtcccgccgtaacggtaaatcaatcctgatcccaatccaccaaacaatccagctagcaaagccgaaattagcaaatcgtgctgcaaatctaaatcgaatggcatcagttgccatagccacagccagaatgacaaactgaaaataccatacaatgtgtaaatcaatgcgcgctttccgagcatgcgtaacccaattaagagcaatggaatgttcaaaaatagtgttgataacgcaggattaatatttagcaatgccttaaaaatcaacgtgatacccgttacaccaccttcggccaggtgattggggatattcacgttaaccagcccccacgcatacatagcggttccaactgtaaaaattgcgaaatcacgtagtcgcattttttcaattagacgctctggcataatattttctgccatacgaattgcccccagtactaaaagcttaatgtgtaaatcatatcacaaattccagtatgacagtcattaaaaaaagacatgtccaaatcgaacatgtctgattgtaccaatatttaaccgcgaccaccttggaactcgttgtaaagcgtaataccaccgtcgatatacaatgtcgttcccgtaatgtatgaggcttcgttagaaatcagccacacagctgcgttagcgacatcgactggatcaccgaccttcttcattggaatcatgccttccgtgtcggcacgaaccgctggatcagcgaaacgttgtgcgttaattggcgtttccagagcacctggtgaaatggcattgatacgaatgccacgttcagcatactcaagcgccgttgtctttgtaaacatcaagacaccggcctttgccgttgcgtatgaagcatacgtaggccaaggaataatgtcgtgaaatgatgaggtgtttaggatgttaccctttttgttatgcttcaagaagtgttgtacggcaatcttagttcccaagaaaacaccatccaagtcaacgtgaagcacacgttgccagtcttcatatgatgtttcgtgcgtttctgattgaatctcgaaaccggcattgttaacccaaacgtcgatatcgccaaaggcttcaatcgccttgtcgtaaatcgcttgcacaccagcttctgttccaacatcggcacgaattcccactgcacgtccgcctgattgttcgattaggtaaatcaaaccatcaatcaccttttcgtcagcgttgatgtagttaataaccacgttcatcgcttcagatcccatgtgacgtgcaatcgcttcaccaataccagaagaacttccagttacaaccgctgttttcccgcgtaaatcaggataacgggttgagtcttttgtatgattaattgtcatgcgttccaccctccgtacatatattgtacattaatgcacatgataaaacatgaaaattctattttccagacatgaaaaaaaccagcgacccaaaattggccactggcttttcaaactaattaacgcttttgcttaccagcattacgaccaccctttgattcagggtgcgtgttttcactggcgtcatctgtaatgtccttacgtgcttgtgcatcttgttgtgcctgcgcagccttcatagcttgtgcaaatggaccagttggttctgattgcaacttaccagacaacgcatcgtcaacaacatccttcacttcgaacgtgtctgcaacgtgttgacgcaaacgtggacgccaaacgatgataatcaacgtttggataatcatgaccaatgcaccaacgaagaagtacaacgcaataccaccgttagttacccaagtcatgaatagcatcatgattggcataatcatcatcattgattgcatttgcttcttttgctcggccggtacgccaaccattgacaagtatgcttgcaaaccgtaaacgacggctgttgcaattgccaacactggtgattgcgttgccaacttaatgccgaagaaacttgcattcaccaaatcgtgtgaattcttaatcgctgcatacaatcccatgaacactggccattgaatgatcaacacagtgaagttcatgccgcctagcaatgatacaccgttttcacgataaacagccatcatcgcttgagaggcaagcatcttctcttcttgcgtttgggcgttcttttgtgcttcttggatcttcgtcatttgtggttgcaacaaacgcatcttttcttgttgaatcgttgcagcgcgttgttggtgaaccataaatggcaacaataccaaacgcacaacgaacgtcaagatgatgattgaccaacccactgcattggcaccaccaatccagttttcagacatgtgcatgaaattagtcaatggcccttcaaggaagtaaccgtgtcccgttacaaacaaaatgaccaacagaatcaacaaaattggcgttaagcctttaatcttcatggaaataacatccttatctatctctttttttaacgtatctattatagcacacggtttttctttgcgaacttactttacaaaaaaacaaccatcaacaaattgatggttgttttagtaagcggacgacgggaatcgaacccgcattcccagcttggaaggctggagcactagccattgtactacatccgcatatttaactacgttgcctcaacaacatagttaataatacaggtaaaacgttgtaacgtcaaccccttatttcatcattaagctgacaaaacgatacttttccgcgcggttatcgcttagaaatgtattcaaatccttgaagttagcgaatatctgcgtaatgtaattatttttacgactggccggcatgaccccgtaccattgcaaatctgtcatcttgtcatatcgcgtattgtccataaaaatgcctgttaccggcacgaccgaaaatgaaaagtcggggtattgcgttgctgttcgatgagcaataccttctgcgtcagattcggttgtggcggctgtcaacaatgtatcgacgtcctcgccgaccatacgaacggcgtaccaactatgctcgtcgctagttagttcatcaattggttgataatcttcttcatctggcaacatcgggttttactcctttcttaattacaacttaccagtcaaaaattgggcttcaccgtaaccaaagctccaatcttcatcactgttaacgactaggttaatcatcacatcttccttgcgcaagcctgttttctcgtgtagctcagacaccaaattattatagaagttaaccttttgttcagttgtgcgcggacgcgttaccaaactaaatactagcaccttatctgtgcgttcgatacctagaccagtgtccaagatttgcatttcataaggctcgtgttgcgtgacaatttggtagcgatcaccatccggtgcaccaaatgcagctagcattacttcatatgaaatgtccaaaatttgcttgatttcatcgggtgtacgacccttgatcatatcgatattcatctttggcatgtgacttgcctccttagttgttatataggttactcccggacctgaaaatgagcaagaaaaaacgtgcctttacaggcacgttttaatcgtcattatagctttccgtgcttcttctcacccaacgtgaacaatacccacgctagtacaccgaagaagattggaccaacaactgtccaaataccgctgaaccaatctcccgtttggaatggtgagataatcgtcaacaaaattgagataattgtcaaagcctcaacaagaatcgtgataatccaagtgattgttgggttcttgtagaagataaatggacgctcaacgtcgttcaaacgcttgaacaatgggaacgcagcaaccaagaagacataaggcaacgttgatgacacattacccatgttcgtcaaaataaggtatagttgctcagcactcttaccaccaaatgaaatcaagataaccaatactgaaaccaagatagcttgtgaccatacggcaacagcaggcacatcatgttcattcaaagcgataaacttctttggccaaacttcctttggtgaacccaagatgaatgacttcaaaggtgcatatgtcaaaacaaagaatgaaccaacataagcgaagaacattgaaataccagcaaagcgagcaaaaattgatcccatgatcaagccagcgctgtgtgacataccaaaggcatcacccaattgcacacccaagttattcatcaaaacatacgtgatgtttccaaggttcgctgacttatcagccgtcaatgacgtccagttagttgaagcaccccatagcaaaattgagatagcataacccaacccgatgattgtcgttgcaatcaaagctgccttaggatacgtcttttcggcgttatcaacgtcttccatgataccacccatttgttccaaaccggcgtaagcaaagatagcgtacaaggcaaatgaaatcatttgaccaattgattgataatcagggctacctgagatgaagaatgaacgcaactttaatggctcggcgaagtgaccaccgtgaccaatcaacacagcaattgaagccaacaacaagatgacgttcaatgccataacgaacataccacccatagcagaaatgcgtgaaattgacttaacaccgcgcgttacaaagtaagcaacgaccaagatgaacaaaactgccaaaacaccaactgtttgaccaccgttcaaaccgaacaatgaccaagttgttgtcatgtccttaccgaaaatcaaagttgacaacggaatccataccttttgtgatacggaaatcatccaaatcacccatgatgccaaaccaataaaagttgcaataaacgcaaccttcttacccaatgaacgttccatccatgagtaaataccacccttagcgtccttaaatgatgcaccaaattcagcgtacatcatagaagttggtaggaagaacaacaaggcacccaaaatataccagatgattgctgcatatcccatacgctcaaaggccacaggcccattggcgaaaccaaagatggtggtgaacatcatcatgattaacgcgccaagaccgattttcttcttgtccataagaataaccccttgaaaaaattcatatttaatttacgaaaaaatcataaatatacatgcaactagtttacgcttgtttctgacacgtggcaattcaatggcctaaatcaaaccgttttctaacctgattaaaacccaattctcacattaccgtcgatgaaacattaagatgacatcaaaacccttataaagacttgactgtttttttatatgtgtgaaaatagaaacattagtaaaagattgaattgagggaattttatggctgtcacggtttattcattttctcaccgcacttcagcgctgaatgcattgaagtcagtctagagctttttcgaacgtaacaacttagactacgagctagtacagttgaaggactcatcatccctccctgtttcagtaccaacgatgcgcgctatctgcgcagctgaggatcctgaggcaaccattttcaagaatccacgcggtatgtcaattgacgattggacgattaatgatgtcattgcaagtccaaacaagtcattgaagtcacctcttacagttgagaccaacgaagctggcgaggttgtccacgttatggctggtattaatgaagatatgttggggttgtttattccacgcgatcgtcgtaagaacgaattgcaagcgcttttgcaacgttctgctgagttggacgaagaagaaaattaatttaaagaaaaagaggagttcgtataaaacgaactcctcttttttgtagctatcaattatgaattgaacttattaacaatcgattcaatgtccttaatcacaagtgacattgttccatccggattattgacgaattcaaccttactacggtcttggtaaatatccattggaatagcaatctcgataccagaatccagcttaaaacgttggagacggtacttcttctcgacgcgctcaacgttaggcacgtcaatcgccgtgtcgagctccttgtctgcaatgacttcgttgtacgcctgcttggccgaaatattacctttgaaaacagcttccgcaatatcagcagtattaatttgaccgccgtcggatactgattcgaaaatagcactctgcgtggctgccattgcttcgtgctcaggcacatcgaacttatcagcgactgtcttaaccgcacgtttaatcgttttgatattgtctttagttgattcctccggcttaatctccaagaaacgctctgagaagtaattgatacggtggccatcaatcagatattgtttctcgaccaacatataagaaccggtcatcaaattaacgatgataccttcatctgctttttgatttgcacccggcaaaaccgcttgattcaaaaccaagttgttaaccaattgatcatcacgataatcaacaatgtgcgcataacgtggcgcaaagtttagcttaatcaagccgaagaagtcatcagtcccctctgcaaactcaaagctcaataaatcgccggccggcaccgcttcgcttgctgcaatcgtatcaaacagcttttcggcgagttgggtggtcttttcggcaaatgacaacccgttattgtcatcaatcgtctgggctaggtaatcctcaccagtcaacgtgcccggcttaaaatcgccagtttggaacttcataataatcttttccagatagtcgtggagtccaggttgagttaaatcaatttcagcttgggatgcaattagattccctgcatctttatccaaaatatgcaaaataacgtgttttaaaatcataatctttatctctcatttatccatttaaaaagctgtggccaactgaattggccacagctttaagtgtactatttttcttgcttaataggcaatgtaattctgaaaatcgacccttgtccaatagcggattcaagttcaatctttccaccataaccttcaaccagcttttgggcgatactcaacccaagaccatttccaccctgcttacgagaacgtgctttgtcgacacgatagaagcggtcgaagacacgcgcagcgtcttctggagaaataccttcaccaaagtcttgcacagccaattgtacgaagttccccgaacgtgacgcagcaaagtgaatttccttgcggtcttggctgtacttcacagcgttgtccgacaagataattaaaatttgctccaggtgatcacgattcatattaacgatagttggccccttcaagtcgtcgtccaagccaaacgtgaagtctggatgtatcatcttgaagttcgtatagatggcgttaatcatgtctttgacatcagtgtcaccctcgcggaaagttaattccacttgatcagcacgtgtcaaatcaagcatttcagaaactaggccttccatgcgtcgcatttcttgcaaagacgcttcgattgactcggccaaaatctttggatcatccttaccccaacggttcaacaactccatgtgtcccttaacaatggccacaggcgtgcgcaactcgtgtgaaacatcttcaacgaattggtgttgttgcaaaatgaagcgttgcatgcgatctagcatgtcgttcaacaaatctgacaagtccgttaattcatcaggacgtcgatcctcatgttgcacacgggcttgcgattgtgggtcggcttgcatttcatcaacgacctttttgatgttgttgactgggcgtagcaggtaatctgataaccaatagccccacaaggctaacaagaacaagcctaggccaatcaaaatcatgatgataaggtacacacggttaaatgttttgtgatacgacgtcaagtggttttcaatcacgacataaccaatcaagtggttatttgagttacgcaactcctgacggccgactagcacagaactaccattaacccgttctgttttaacactcaaatctgagacacgttgaaatggcacgccagcaccaccaattggataaacttggcgcccatttgtgttatacaccatgactgtgtagtcctgacgcgtaatctgttgcataacggggtcgttaaccaccttgttcaagtcatttgactttggtcgcaacatggcatcaacatcagccggtgataatttcttttcatccagattttgcaatcgcgttgtgacaacctgtagtgaggttgccacttgttgacgctcggtttttaacatttgtgatgaaaaagcctgcacaacaaaccaagcaaagattataaatatcaaaaaaacaccggctgcggaaccgagtgcccacttccatttaagtgagagtcccttgcgttgcggtgtttcagtgataatggatgcattgtccattagtcgcccccaaaattactgacgcataacgtatccagtaccacgaacggtttggatgtatgatgcgcgtgagtctggttgatcaatcttattacgcaagtaacgaatataaacatcgacaacattggtttcgatttgtgagtcgtaaccccaaaccttcttcaatagttcctcacgagattggacaacgttaatgttttccatcaagatcaacaacaattcgtactcacgctttgtcaaattaatgatttcgttaccacgacgggcaatgcggttttccttttcgaccgtcaaatcacggtaacgaacaacgctttggtgtgtgctgtgctcttccgtctcaatgttaatacgacgcaacaaagcgcgaacacgggccaacaattcttcgatggcgaatggcttaacgacgtagtcatccgcaccgtaatcaagtccagaaacacgatcaataactgaatcgcgagctgtcatcatgatgattggtgtgttcttcacttcgcgcaaacgacgtgctacttccaaaccactcaattctggcaacatcaaatccaacaagatcaaatcgtaatcattgtccaatgcagcttgcaatccacctcgaccgttgtcttctacgtgcgtttcataaccttcgtgttgcaactctagttcaacgaaacgcgccaaatttacttcatcttcaataacaaggacactactcatgtgcgatacctcatcttactttctacaggatacggtcactcccctgaagtcatgacattttaaaattagcataacatgattttctaataattcctagtcttttgccattctgacggtcattcggactctgaaaatccattagatttccggttatgttgataaacaaaaattgctaacgtaattggcaacaccaaaatgacacctaaaatcgcgtacaacaatgacaacattgatgacgtaaataatttcgcattcataatctcaccgatggtgtaatgcaatttaccaaaccaaattgctaagctcaaaaagtcagccataaatccaaataagacggtgttaacagccgttccaatgatttgctgaccaagcttttgtcctgtacgaatcagctgactggtcttcatgtttggttgatcatgacgtagttcgccgacaccagcagcaattgcgatggctgcctcggcaatcgcaccgagggttgcaagtaaagcagctacgatacctaacgtgacgaaattaacattaatacctaatgataatccttctagttcttctgaattttcttcagcgaatccttgcgccatcgctaaatgttcggctggcaaaatcagcaaaaccaaggcgatcatgacaatgaaacttgcaatcaaggtgattgacgttgtttcttcatcggcaccagaactcaagatggtgatggtcaacaaaaaggcaccaccgactagcaaaactgccatggcgttgaattggaagttaatcaacataatcatgacaatcatgataccaaaattaacccacaagctagcaaaggcgccaacccctttaccaccaccgatggcgaccattaaaacaaataaaataatggctaataccatggttactgtcatcttggcacctccgtcttaattcgggtgaacctacgaactagcaatacccacatgatcccggcgggcaccgttaagacaatcccaatggcactaatcaacgtttgcaccaaccccagtgacatattcatcatgtacgtgaagccccaatcgttaccattgcgcaaatacaagacagccattggaatctgttcagcaatgaaaattaagaatagcgtattactcaaagcaccgaaaatttcttggccaacgtggcgaccggactggataatttcacgaattgtgatattgggacgttcgcgttctaggctaaacaacgtcgcaatcatatcggttgcttcatccataacggcgcccaaaacaccgactagggtcattgccataaacaacggctgcggtagctgcgtaataaacgacatcagttcaaagtgcaaaccatgattattggtcatcttaaagacaatcgacgcaatgatcatcgctaatgcagttgctgtcaaaacagtggcgaacacgacccaggtctggcgttggcggaaccccataactaaccccagcgtgattgccgatgctagcacactaaataacatgaacaagccaaggatattgccattagtcgtatgtaaatccaaggacaccgtcccaataaagagcaccacattaacagccaggggaatcacggttaggcgaccggcgtgacccattgaaataatcaaaataccaagtactgcaatcatgatcggtacccaaacggtatcacgtttcatggtctggaccgtccaagtttgatggtcagcgcgatttaagaaaatttgattgccaactttaaatggttgttcaatcgccattgcggcatccgatgtattcttcactgtgatggttttaccggcttgattggtattcaacaactttacgcttaaagactgcgtggtctctttaacgtcattgttgtattggtctgttaatcggttggtttgtagcaccttgacctgcgtcacttggcccagaggcgtacgataccagctagcgttgtgacgcaaaacaaccatacttgtcagaataagcaatattaatacaagccaagggcaccactgtttcttctcaacatactgcttcattaatcaaatacccgacgattgtcgccagccatttgaatttctttggccaagaaatgaatgcgttgcatcaaacgttctgccttaacaggctctgcaccactcttggtaactgtgaaatgctctttttctagctggtccattgagaagttcgacgtgaagaaagttggtaactcattttgcatacgatattcaaggataacgcccaaaatatcatcacgaatccaagcagtaatcgattctgccccaatatcatcaagcaccaaaattggcacacgcttaatggcattaatcttatcttgtggattttcctttgaatcaattgacccacgcatttcaacagcaaagcttgggaagtgcaccaatgtcactggaatgccttcttgggctagttcgttagccatggcgcccatcaagtgggtcttaccgataccgtatgacccgtgaatatataaaccacggtgataagcctttgggtcagcgatataagcactgacaaaattgataactgccgttaatgcagctaatcgatcaccatcatcctcagaaaagtcgtccaaacgtgcccgttcaatgagctttggcatcccaattgattgcaccaaatttgcttgcatttgcaaacgttgcgcagccagcgtttcttcgtcaggttggtaaacaatcacaatacgattttcagtcacttcaagcattggcttatacccacggtgcacaaccggcttcccagctgctgcgttcttaacttgtgtgtagaattcgtacaagacggcaaagtcacggttcacaatgtcacgtgtcaaaacgtccttgttttgctcaaaaaaggctttgataccaggctcggcaaaaacctctttttgaatcgccgcgtaacgggcgtgtaagttctttttgttcatgaattgatcgagcgcttgcccaacatccatagggttatccgaatcagtttgacgattcagatgaaatgtttcatcagccattgttaattctccttgttagtctgttgtcgacgagcgcggagttgcgccagttgatccttagcggcctgagcagcctcttcagaaacagttgaagctgtttggttttcccaatcaggtcgcgtttcattaacctgcgctggacgttgccattgacgaccgtttgatcgactcgcaacttgcttttcttgcttggtttggcgtgacttcgcacggcgttgcaagtactcaagtgctccgacggcagtggtgacctttgcttgtgcccaatcgttaacaattgtttgtagcaacgctttgttcagggttgccttcttttcaacgactgtcaattcgtaaagcatcacattcaacacttccggtgctactttgtctaattgtgcaatgtcttccaacgccttgacttcagcatcggtcacaaagccaccactcacttcgcgcaagttttttaagaatacaagcggtgcagtatttttagcagattgaatgattgcttcagctggactcttaacgttcgtatccggcgtcgtctgcgttacttcgtctggctttgatgtcaccaattcagtatggtgacgttggtcagattgataactcttttttagcattgtgcgaatcgcatccatatcaatgccgttgtcaggcgtaatcgtcgcctgaataacgcgtaccaaatcaacatcccctaagccatacaagtttttgacaatcgtcaagtccgcctcgtgcttgcgaatggctgacgcagacacaccaaatgtgcgtagcatgtcagtcaaaagtgacacgtcaacggatttggccgattgatgcagttgcttttgtaagtcgctcttcgtgtcgtcgttgtttaagggtgcttccggcaacttttcaaatgacacattacccatcatgtcaaagaaggttgttgaaacattcacacccggaattgtcgcgtcctttggcttaatgtcatcaaccaattgttggaacaattcatcacccaaataatgcgcaagtaaacttgatagcatggtatcagccaaaaaggccttcatggtcattggtggaaatagccgataaacccattgtgacccgaagcttgtgtcttggcgataggtcttaattaggcccattccttccaggttctgacgagctgacaaaaaatcgtgttggctaattgctaattgatcaagcaaatcaacgtgcagattctgagcatctggcgtttcgcccatcattgcccaggctaaataaagtgtaaacgcatcacgcccaataattggcaagtaaaccttggttagcgattgtacagcgccaaggtcaatcggttcatcatacatcagccgataatgctgacgaattgaaaactcagccatgtcggcctccttgttaatttagtgtggtaatgctgctaaaacagcatcaacttgcgaataagtttcagcaatagtgcctgaattgtcgatgacatagtcagctaatttttctttctctgccattggcatttgcgaattcatgcgtttgcgagcctcatcggccgataattggttacgagccattagtcgttcctgctggacatcagccggaaccgttacaaccatgactgcatctgcgccggctgcattcttcccttccaataacaatggaatgtccaacacaatgagtggtacacctgctgctgcgtatgcgtcagcctgtgctcgcatgcttgcttggacacgcggatgcgtaaattgatttagtttcgctaatttcgctgggttaccaaagacaacagagcctaatgctttgcggttcagcgtgccatctggttgcaacatctcttcaccgaactcagccacaatatccattagtgcgggttgtccaggttcgacaacttcacgcgcaatgacatccgcatctagtaccggaatacccagttctttaaagtggttggatacagttgacttaccggtcgcaatgcccccagttaatcccaatttaaacatgtttttaatcctttactacttggcaaacagggcaataagttgtcccacgttgtgcaactttcatcttctcaagtgggtgtccacaacgtagacacggttcaccaacgcgaccgtatacttgtaactcgttttggaattcgcctgcttcaccaaacgctgttgtaaagctgtgcacagtggtgccgtggtgttcagtcgcacgggtgatttcatgaatgatattctcacgcaaacgtgccagttcatcctcacttagcttgttagccgctgttaacgggtgaatttgtgattgccatagtgtctcatcaacataaatattacctaaaccagcaatgtggctttgatcaagtaagaatggcttgacgtgcatccgtgacttaccgaactcactttccatataagccaacgacaaatccttttcagttggctctgggccaatttttgccagtccagcgacctgtaatgcgtcagcatctgtaaccaggttcatgcggccgaatttgcgtgtatcacggtaaaacagatcaatgccctcatcgagatggaatgtgaccaggtcatgcttaccaggttcagtacccgctggaacagtataataagccccttccatacgtaagtgtgacaccatggttaagccaccagagaatcggaatagcaaatatttaccgcgtcgatccactttttcaattgttcggccaactaattcagcatcaaattcttctggtgccatgccgctgattgtcttttcccagcgcacctctgtaccgagtactttacgtcctactactagtcgtgtcagaccacgacgaaccgtttcaacttccgggagctctggcatgattaaccgcctttccgaccgtgtatttcatccacggtcatgtgtcatttatcttatttagtttaccatttttaacaggtgacggttagacaaaaaatgtaatctcagcaacataaatttttaggtaaaaaacaggtaacgtatataaaaagactcggcaaatgaattgtcgagtcttcaaaatatctattacttagcgtcgtaccagctcttaccttcgtgactagcaactgatagtgggacatccaacttaacagcagaatccatgatgcgtggcacaagctcatgcaatgcttcaatttcgcttgccggagcctcgaagatcaattcgtcgtgcacctgaagcaacatcttagcttgcaacccggcatcagtaatggcttgctgcatgttaatcattgcaatcttgataatgtcggcggctgaaccctgaattggtgaattcatcgccgtacgttccgcaaagctgcgagcgttaaagtttttcgccttaatatcaggcaagtaacggcggcggtgagcaatcgtttcaacatagcccttttcgcgtgctgatgcaataatgtcttctgaccattgcttaacacctgggtattgctcaaagtatgtgtcaatgatttgcttagcttgctttcgtgacacaccaatgttcttagccaaaccgaagtcagaaataccataaacaatcccgaaattcacggctttcgcttgacgacgaatgttgccatcaaccgtttcctcaggcgctaggccaaagatacgacgagccgtggctgcgtgaatatcttcaccgttaataaacgcttcttgcaagtgcttatcgcctgtgatgtgggccaaaacacgcaattcaatctgtgaatagtcggcactaaaaatcatccagtcatcttgacgcggaatgaaggccttacgaatacgacgaccttcttcaatacgcaccggaatgttttgcaagtttggttcaactgatgacaaacgaccagtctgcgtcagtgtttgcaagtaacgcgtgtggacctttgaatcagaaccgtgaatcacacgtaacaatccttcaacgtaggttgattgaatcttggcgatttggcggtattccaaaattgacgcaactagagggacatcccccatttgctccaacacttcaacactggttgaataaccagtcttcgtcttcttaataggcgtgtagcccatttcttcaaacaaaatcacccctaattgcttaggtgattgaatattgaattcatgacctgcttgctgataaatcgtttgctcaagttctgacaaacgttctgtcaacttgctacgcatttcaagtaacgtgttggcatcgactgtaatacccgtggcttccatgtcagctagcacataggtcaatggcaactcgatttcttcgtacaaattcgtttgctcatgatcagctaactttttagtcaacggcgccttcaagtactgaatagccattgctttgcggccaaggtgttcaaacaagtcctcatcagtttcaggaatggcaaacttagcccccttgccataaacctcttcatcagtacgaaccgcatagtagccgttttcgtgggctaatgcgcctaaatcgttattattgtcgtttgtgtctagcaagtaagcgaccaacaacaagtcgaaatcaactgcagggaacgttacacccagacgacgcaacgcaacgatggtttccttagcgttaaagacgttctttttaatggctgggtcttgcaacagcttgttgacaggtgtaccttgcaccaacaactcaatatcgcggctgacaaagtagccatgctcattattaccaattgcgaaaccaacaggtgcggctgtatggtaattatcgccatcaagttctagataaaagctgacctcatcacccaattgttcaatatgggtcaagttcgtagctgttaactcacgaacttccaatgatgtattgctcatatcgtgaacaggatcaccattctcatcagccgcatcgtgtagcggtgccggaatagtgtgaccttgattagccagcttcactagttgtgccttgaagtctagatgttgataaaacggaataatcgcatcataatctggaccttgataagttaagtcagtcaacgtgtaatcaactggtgcattcgtgcgaattgtggccaagtcacgtgacaacaatgcatcttccttaccagcgaccaacttttccttttgcttagaggccttcatttcatcaatgcgctcatacatctctggaatggtgtggtattccttcatcaacttaatcgccgtcttaggaccgataccagcaacaccaggataattgtcactcgtgtcaccttgaagtcccttaacctcaacgatttgggcggctgtcaaaccatcatacacttcagcaaccatggctggtgtgtagtggtccatttcagtaattccctttttagttacccaaacagaaacatcgtcggtgaccaattgcgtcatatcacggtctcccgtcacaattgtcaccgcatatccggctgcttctcccatacgggcagttgtcccgatgatatcatcggcttcgtaaccaggaagttcgtaagacttgataccgtgcaattcaaccatcttacgcaatggctcgaattgttcaaccaattcttgaggtgtcttatcacggttccccttatagttgtcaaactttcctgtacggaatgtcgtcttaccggcatcccacgcaaccaacgccaaatcaggcttaaacggatcaacaataccgtccaacaggttattgaagcctaccaaagcgtttgtgtgtagtccttcgtgatttacaaaacggtcaacttggttaatcagtgcataaaacgcacgaaaagccagtgagttaccatcaatcaatagtaatgttggttttgccatgtttatctcatttccgggtgacgtttcacccaccgtagtcatatcttaagtgtaacagaaaagcgcctcgcaagtaacgagacgctctaatatttataacggttttaatcgcgtgatccaccgaatgcagtgaacaattgaatcatgtagatgaacaagttgatgaagtccatgtatagtgacaaagcaccagatacggccataccttgttccatatctgcatcaccagcaaattgcatgtacattgccttcaaacggttcatgtcgtatgccgtaaacaatgcgaagacaagcacaccaacgactgacaagaacatgtagacaatgctgttaaagaagaacaagttgataatcccaccgataatcaacgcaatcaatgagccaaacaagatagatgacattgatgccattgacttcttagttgtcacaccgtagaaagccataccagcaaacaagaaggctgtcgtcaaaaacgccgttgccaatgttccgattggtgttaccataccgattaccgtgaacatcaaaccgttcagcaccgcaaatcccatcaacataccgaatgcttgggctgggttttggtaaacacgcttaccgaacaagtaaacgaaaccgaacacaaccccaatcatgatgattgatgaaattgggctactgaaaatcgttgcgatttggcgcgcaaacatggtaatacccaagtatgctgtaaccgccgttaccaacaaggccaaagccatgtatgtgtaaaccttcttaaagaaactgttcaagccttgcatatctgggttaaccagacgtggctcttgttgttcaaatccaaaattatccatacttttaatacctctttcgttgtccgcagacaatgttttggttaactaccccaatgcttatattataacaaaaaccttaaccgaaactctatggttcagttaaggtttttcgttgttttttactgtaggtttgattgcgtgttggctagaatcttttcaaatgcaaactctgtgttctgcaaatcaccggcacccatgaagatgaagacaccctcctcgtgatccaacaatggtgcgacgttagttggtgaaacgataccaccaaactttgaaatcttagcacccaagtctgatgatgaaatatcaccagcggcttcacgtgctgaagcaaagatttccgtcaaataaaccttgtcggccaattcaagtgacttagcaaaatcatcttggtacgcgatagtacgtgagaatgtgtgcggttggaagacggcaaccagctcacgacctgggtacttttgacgcgctgcatccaatgtcgccgtaatttctgatgggtggtgtgcgtagtcatcgatgatggttacggggccaacttgcttctcagtaaagcgacgcttaacacccttaaaagacaacaactccttgcgaacaaggtcgccatcaatcttttcgaagtacgcaacagcaatgacagccaaagagtttagcacaccgtgttgtccgaacaaaggtacttcgaagttacccaagaactcatcatggtagtacacgtcaaagctagaaccagttgttgaacgcttgatatcagttgcgtagaagtcatctgtttctgggtttgtaccgtagaagtatactggtacatccaccttcatttggcgaagttgtggatcgtcaccccaggcaaagattcccttcttaacattgtttccgaattcttcgaaagcgctacgtacatcatcaacacctgtgtagtaatcagggtgatcgaagtcgatgttcgtcataatggcatagtccggtgtgtagtccttaaagtggcgacggtattcgtcagcttcaaaaatgaagaagcgtgcgtcaggcacccccttaccagtaccgtcaccaatcaagtaagatgttggggcaataccagccaaaacgtgggccaacaaaccggtcgttgatgtcttaccgtgagcaccagcaacaccaattgacgtgtattgcttaattaggctttcaaccatgtcagggtaagtcacaaccgtcacttgatcccccattgccaaagctgcggcaacttccacttgatcatcagtaaaggcgtttccacgaataatcgtcatacctggcttaatgtttgctgcgtcgaatgaatacattggaatacccgcggctgccaaaggcttttgcgtaaaggtatattcatcaatgtcagaaccagcgacttgtaggccttgatcgtgaagaatcaaagcaagcgcactcatacctgagcccttaattccaataaagtagtacaacgtatctttgtccattttcattcgtccaatctgtttgtaagtaaaatctattatacacgtaaaaagacctccagacaaaaactcagcggaatgtaaaaaagccttaaccatggataattcacggttaaggcttcacagttatttagtcttcgaaatacgatgtttcgcttttagcagccacgcttgcttcttctgataaaatatcatccaaactcaagcccagacctgttttaacatgcgtgtgagcatgcttttcatgggtcgctactggtgcttcgctgaccgcaaccgaggcaactggcttggttggaactgccacctttaccgcttgcggttgcaatgtttccacaataattggctcagttggttcagccacgcttggcgtttcaaccacttcaggttcaactgccggctcagcaagtacatcaacagcgtcttcagacgaatctgcccacatgacataagccgtcttagctaacatcaagtgcgcaacctgctcatcgtagttttccattagacgttcataaaagacgatgggacgacgatcagccatgctgttacccccgtcttattggaacaacgcttgggcttcggctgagcttgcgtcgaacggcgtacccacttcggcaaaatcgtcaggcaagatcaaagcacctggcacttgtggtgcgtttggtaaacgcaactcacgaccagatgtaatcataccgttagaggcaacaccacgcaaagcacctggccagataatcaaacctgaaggcatcatggcaccaaccttagcaacaacaaccttaataccttggcgcatgtttggtgagcctgacacgatttgcacgcgctcatcgttatctacgaccgtcgttgtcacttgcaagtgatctgagtctgggtgtggctctgcagactcaacgtacccaacaacaaacttaggtgtcgtatcagctaccaatatatcctcaaatccagcagttgcaagcacatcgttcaacttggcaacttgttcttcagtcaaaataacttggccgttaacatccgacaaatcaagaatttgtgaagcgttcaaaaaattcaatcccaaaaggttgttgtccttatcagcaaggcgtacaacatctcccttttgtgttgcggtgtgctcagctgcaggcgcagtcaacacaaccaaaacatcacccattcctgctgggttatagctggcaatcaacatcttgtcagtctccgtttctttttttatttattagtcaccgtaaatgatgtcatttacagttgtcttatcaagcttttgtgcaagtgtttcaaccagtgcttgagcagcttcaaaatctgaaactgaccaaaccgtctggtgcgtgtgaatgtagcgtgacgcaacacccaatgcaactgatggcacaccagacaattgtgattgtgcgccgtgtgcgtcagtaccaccctttgcgacgaagtattgcaaaggaataccggcatcatgggcggtatccaaaacgaattccttcaaacgcaatggcataatgacacccggatcgtacacgcgcaataaggcaccgtggtccatttgaccttgtccttgttctgattgcgtatcatccgctgcagatgaatcaagggcaaagaaaatatcaggttgcaattggttaacggccgggccgacaccacgcagaccaacttcttcttggacgttagcccctatcatcaacgtattaggcagtgcaacaccttgtaagttctcaagtgcattcaaaatcgtgactaaaccaaaacgattgtcccaactctttgacacaacgcgcttgccattagccaacatttccgttttaacagctggcacaatgaagtcacccgggtgaacaccgaatgaaattgcttcatcagctgacgtaaaaccaccatcaaacaaaatgtcttgaatcttcggtgccccattcacaccaccttcacgcaaaaagtgtggtgatacggctgaagacacaactgggtattggttatcgcgtgtaaagagtgtgaagcgttgcgccgatactgtataagggttccaaccaccaactgggtcaaccaccaacatcccgcgtggcgtaatttgcgtcacgatgaaaccaacttcgtccatgtgagcgccaatcatgatacgtggcgcatcagcattctcgttgtgacgaatgccatagataccgcccaaaccattttgaacaacttcatcaacgagcggcgtcaaatcctcacgaaaggccttgcgaacggcatgttcttgaccagaggttccttgcaactcagtatactttacaatacgattccaaatacgttcttccatgttgtgtcacactttcttttttacttgtgcaaatctagaatggcgcggatttgcgcttccaacatgccaataccaacaacgttagcgccaccttctggcaaaataatgtcagcgtatcgcttcgttggttcaacgaattggtgatacataggcttaacggttgccaagtattggtttacaactgattctgtcgtacgaccgcgttcgacaatgtcgcgttgcatgcgacgaatgaaacgcaagtcgtcatctgtgtcaacgtagaccttgatgtctaacatgtcacgcaattctggttcagtgaacagcaagacaccttcaacgataataacgtctgaagcttcaaccgttaccgtcttatcagaacgcgtgtgcgcagcgtagtcatacgttggttgttcgattgattcgcgttgcaacaattgcttcaattgtgcaatcaacaaatcattatccaatgaatctgggtgatcatagttcgttgcaacacgttgcgtcatactcttatcactttgatccttgtagtaagcgtcttgtggaatcataaccacagactcacccttcaaacgctcgatgatttcacggctaaccgttgtcttaccagaacctgagccaccagtaactccgataacaactggacgtgaattagacatagtacaatcctctttcttcaattcaattctttaaatataacttattgtaggggtagtgtcactgtaatggttgtcccaacaccaacctggctatccaagtcaatggtgcccttagcttgatttactaggtcattgacaatggcaaggccaaggcctgtgccaggtatcgtttgattacgtgacttatcaatgcgataaaaacgctcgaatatacgattttgttgttcactcggaatccccagaccggtatctttaacagccacgacaaattcagaagctgtgaccatagcagaaacctttaccaacccatcgtggcggttgtatttaacagcattaacaattaagttggtcaaaatttgacgaagcacagttgcatcctgcgtaaccgtaaaggatggcgcaacctcattctgaagtgtcaactgttgcttgtcagcattttctgcctgggacttgaatatatcattcaccatatccgataacttaattggtgtggcagtttcctgtcgttcaggcactttggcgattgtcaaaatatcttccgtcaattctaacaaacgattcgtttccgtttgaataatcgttaagaactcttggcgagcctctggatcctcctgagcaccgctcaatagcgtttctgtaaagccagaaattgctgtcaacggtgtgcgcaattcgtgcgacgcattcgcgataaaggcactctgcatatcttgcatttgcgtgacctcagtcatgtcgtaaagcaagaccaacaattcgtggtgtcgttcgcgtgtctcgtaataaaccagtgacacatcgacaattcgcgcatctaatttaactaactcacggacgtgtgtttgacgcttaagtgactgctcaaacaatgacaatagtcggtgattcttaataacgtcatcatattgacggccgacgacattttgagtcaaaccaagaagcgcttgggcttgtggatttgtctgaataatcgttcgctctggcgtaatacgtagtgcgccaagtggcatattagccatcaacgcagccaatgtactaccttgctgttgtaacaacttgatgcgatttcgattgaggcgttggacatcattaatcgattcagccaacggtgccaatgaatcgtcaggacgcatcagaatgtgtccggcacgtgtattgtccgtttgcaaatcgcggagtttatcaatgaaaatggccatgtgttggtcacgacgttgctgttgtaaatccagcactagcgttgcgacacacgccaaaatcattgacagcaataacagcaaatgtgcttttggcattcgcgtttcatcacctgttaacgcagcgaccaggaaaagcccccagattagcacgaagaacaaggcccagaaaatgacaaagcgtttcgcattatgcattaattctgattgcatgatagtcctccctattcagctgtcgcttgattatcaaaacggtaaccaaaaccacgaaccgtctttagatgcgcgggatgttttggatcgttctcaatcttgtcacgcaggtgcgaaaggtgcatgtcaaccatgcgtgtgtcaggccccgtaaattcgtagccccaaacaccgtgcagaattgtttcacgacttaatacacgcccctcacgttcagccatataagccagcaattcatattccttcggtgtcagtttaataacctcaccatcgcgctgcacaaccatcttgtcaaaatcgattttgatattaccgaattgcttcgtcttattctcgcttttgttctcaggtgtcgtcacgtcgaagcgacgtagcacagcccgcacacgggcaatgacctcacgagggctgaatggcttggtcacataatcgtccgccccaatttctagacccaagattttatcaacttcctcgtccaaagcagtcaacatgataatgggaatgcggttcttttcagcacgcaattcacgggtgacttcaacgccactttttcctggtagcatcacatccaacagcataatgtcaattggttgttctgccagggttgtaattgcacttggcccatctgtagcactgacaacatcaaaaccagacttcttcaggttataagttagcagtgtcaccagagaaggttcatcatcaacaactaaaactgtcgtcatcacggtaactcctgtaattaatattacttctagtgtaccacgactttaccggcttctgacttgtaattctaatttttcgccttaagtgaatgaacattcgtttaattaaataagcaaaataaaaaggcatcactgccttttgtgtaaatcgcgttatgcttgcgccaatttcgacgcatgcttgcgactgattttcttaatagcaaacatgccaacgagcatcatggcaccaaggaggaacactgtccactcccccatttctgaaacgccataaccaaacgatatcgtaatgattggtgcaaataaatcggtagcaaagaatgaaataccaaatacacgccccaagtattccggcgcactatcttgttgtcgtacggtattaatcttaatgacaaatgacgcccgtgcaaagccgttcaagatcacgagaatgacgaatacccacaacgtttgcacaaacgtgcctaataaaaatgcgacgcccaacacataaaagtcccagtaaagggtcttcaatgaatttagatgtggtagacgggcgaacagcagaccagccacgataccggctaccgcagccagcgtcaaagcggtcgaataatccgttgcggttccatgataactgtgttgaatcaaaaacggcattgcgatgatgaatccttcgaagaagaaattgctccacatcgttagcagcattgattcgaacagccttggctgtgatacaacatagcgataaccaccgatcaaactttgccaaaatgattctgaatgaacgctctcgtgtttgggcgttggttgatacttaattgccaggttcaatccaactgtaattaacaacatcaccccgaagatttgtaggaatgattgtaggtcaatccatttcaagtgtaatagtagcccaccaaccagcggcccaaaagcttgtccagttgaaaaggctgcagatgcccaggcgttaaagcgtgccaaagcactcgtcttaatgacatccggcaaaatagctcgtgctgccggataagcgaatgaaacatcaacatttaagatgaacgttaatgcaaataataaccaaagttgtggatgtgcaggattaatcaccatcgacaacgtcaatgtcccaattgcaccgaacaaatcagcccctagcaatacccacttgcgattaaagcgatccaataccgaaccgacatacacatcattcagcagataaaccaggaagccaaatccagttaaccaacccaatacttgtgcgttaccgtaacttgaaaccaaaaaccaatttaagccaaatcggtacaccccatcaccaaaaactgatgcaaaattcgaagcaagcaatggaaaactaaacttcgctaatttcgattctctttcttgcatggttacccctctctgaaaaacataatgtgcttagtgtagcaaactctgtctgactcgtcactgccgaattgtaaacaaaaaccagaaccaacaatgcggttctggtttaagaatttcaattaattataggaacttaatgaagaccacacccgcagccatcacaacaacacccaagatttgaatgcgtgacacgctgatcttagctgatcgccaccagccgaattgttgaaccaacatagaaccaacaatttgaccaatcaatcccattgtaattgtcaatccagcaccaatttgtggcactgacaagacactggcaaagacgaacaaaccaccaaggataccaccgagccagttccagctcttagcttgcttcaattctgacatctttggcaaacgcttgtccacaatcaaagcaacaatcgtaatcaagatgaagccaacgaagaatgaaatgaatgatccttgggcaggtgcgtgtagcaaagcacccaagcgaccattaatagcttgttgcatcgctgagaatgcgccggcaataattgcccatacacgccaacctagcaattcagtgtgcgtctccttggcttggattgccttatccatcgcctcaacatccttattcaagacgtttggcaaaacaacggcaacgaccaccccggcaatcaaaataatcacaccgataacacgtagtgccgtcaaaggaattggttgtgaaccaaaccaaccaaacgtatcaataagcgtacccatcaagatttggccaaggattggcaaaacaactgtttgaatagctcccaaacgtgggaatagcaacacgtttgatgtcaaataaacggcacctagtacaccacccaaccaaatccaagctgggtttgattgaataaaggtcatcgttggaaatacttggtgtgactttacggcactaacaatcgccaaaaagactgaaccaaccaaaaatgagatcgctgctgaaataaatggtgagcccaccaccttcttcatatcagcgttaatagggttttggttcgcaagcatgaaaccagcaaacaatgacaaacctagaaatacaaaattcactgctcttctcctaaaaaataaaatcgttattaatgaatgctttattattgtaagcctttaaagatgtaatgcaagcattttgagcaatctattttgtgaaaaataacgctttttatttttagaaacgcctattctaagctgttttaaattttatatgattgatttttcttcacaagcttgtgaaataaaaaagagattagtcatcgactaacctctttttgaagatatattaatcttccttacgcttcaaatcttcgcgtggtccgttgtgcttacgacggcgctttggcaataggtaacgacctgccaagaatacaacaacaaagacaacgattggccagattaatagcttccaccaattagatggattcttccaatcatcagccgaattcacttgttgtcctgccaattgtgcaacttgcgcggcagtaacctttaacgtacgcgtttcagttgttttaacatcacctgacgcaacagtcacgtgcaccttatatgtgccaaccttgattgacttaatgttcttcttaatgtcgaatgtaaaacttgattgtggcgcgatatcgacgttgccatttttttcgtaaacaaccttatcattcttatctgtcacaccagtcgtgacggtggcatccttaaccaacgtgttggccttgttgctcaaagtaacgcccaatacacggtcagctgacaagtcgtttaggcttgctttacccactttaagcacaggctttactggcgttgtatcgttttgtagaataactggaatttcagacgccgtatttgaagttgttgatcgtacaaatgagacaccacccactagttgtcccgcgaatgcttgatcaggcatcgtgattgttccttgaactgacgtttggccttgagctggaattgtgacactactttgaatgtcaatggtatcaccaaccttatatggaacttgtcccgttacgttttggctacctgtaacgtagttcaccttaccattttcgcgtgttgtcgctgtaccaccagtcaaacgaagcgtcatttctgaatccgtattgttcttaatatagaacgttacttgctctttctggcctggtgccagcttcaaatcaatcgatgacaagttgttcttgtcaatttgagaagctggaatgtccgctgtaatatcatatgcgggcaatgtgtctgctgaaaccggcttcgatatgccaatcaaagcgagtgccaaccccaccgcataaactgcatgtcgtaatttcataaccaataaacccctattttcgcttattatacgtaattataatgactttttcttttaaaatgcacgcaagtacgctttacaggactactgtacttgatacttttgaataaagatgtcttatttaactaagaatcgcatgtttttgaaccacataactgtcaaaacgataccaacgattgccaataaactaacagcgtataataacgcctctatgaatggcacctttttaggatgtgcttcatctgttggcgcagtcttttttgacagcacgatttgcttttgccaggtttgatttgtcccgctccagcttgcttgcacctgaatgcggtatttattgcctgtcaggggcttggcatcgtttttaacccaatatgtcataactgaattaggcgccagctgcgcgttccgtcgcgtctctacaagaaccgttttatttgtggacacatcgattacctttgttgtaaacgttgcgccgttaataaacgatcctgaggtattcgcaacggcaatcgcaaagccagtttgtttattgacagtttcatacgaaacggcatgaagttctgccgaagttgccggcaaatttcgtgtgtttcgtgcaagcaccgcaacagttgtttctaccgcatcctgcttttgtgtcgctgtcagtgagaaagaaactccaccagcaataatcccatccaccggttcattcggcatggtaatcgtaccagtgacctttgcatcgcacttaggcgcgactttaatcgtctgctgatccaaatgaattaagttttccatttgtgggccaacgttcccaatcacgtgatgatcgttatatgtgacttctcctagtggcgatgtggatgcagagcccgcagcaacgttcaatgacaattctgagtctgagttatttttgacgtcaaacgtcactgattcaacttgcttcggatttagcaataaatcaaggtaatttttattttgactgtcgagttgagtcttagggattaccggcgtaactgtgtatggtgcattatcgtctgcggaaacgtggcgcatcgtcgtaaatgccagtatcaaggccaccaatccaaagagtatttttttcattttctgctctccatgctttgacaaaaaagaaaggacgaggtgcaacgccctcgcccttttcatttcgtcttaattagtccaagaaatcacgcaattgctttgaacgtgatgggtggcgcaacttacgaagtgccttagcttcgatttgacggatacgctcacgagtaaccccaaataccttaccaacttcttccaaagtacgcgtacgaccatcttccaaaccgaaacgcaaacgcaaaacgttctcttcacggtcagtcaacgtgtccaaaactgattccaattgttccttaagcatttggtaagcagctgaatcagcaggtgaaatggcttcattatcttcaatgaagtctcccaagtgtgagtcatcctcttcaccaattggtgtttccaatgaaactggctcttgtgcaatcttcaaaatatcacggaccttgtcagtcacgatgtccatttcggcaccgatttcttcaggcgtaggttcgcgacccaaatcttgcaacaagttacgttgaatacgaatcaacttgttgattgtttcaaccatgtgcacaggaatacggattgtacgagcttggtcggcgattgcacgagtaatcgcttgacggatccaccaagttgcataagttgagaacttgaatcccttacggtaatcaaacttctcaaccgccttcatcaatcccatgtttccttcttgaatcaagtccaagaattgcataccacgaccaacgtaacgcttagcaatagaaacaaccaaacgcaagttagcctcagccaattcttgcttagcagtttcatcaccttgctcaatgcgctcggccaaagcaacttcttcatcaccagtcaacaatgacacacgtccgatttcctttaggtacatacgaacagggtcattaatcttcatgccagtaggtgcatcagcagcttgcttcaattccttttctgacaactttgtcttcttgttttcaagcgcacgtgcggttggctcgccgttttcatcaacgacagagattccagctgattcgatcttctcgtatagttcatcgatttgatcagcattcaaacgcattggttgtaccaaagctttttggagggcatcttcattaatttgcttatcagccttgtattccttaataagatttttaacaaccttatcaaattcaacttgatcaaactttgctgaaattggtgcttgcttttctgccatagcggcctccttaattacttgtgggtctgttgttcacgtaacgccgccatatactcaacactaagttgagcgactagcgcgtcattgtgcatttgattagcttctttaatctgacgctgtaacctattaattctatcagataatggggcatcgtggctaataaattgaatatacatgccaacttgactacgatcagcgaataattcgtcatcaaaatcatcaagcgttgccaaaatacgtgtcaattcaggtttctgaacaaagtccataaagcctgccatatcaacaattggctcattgccatgtgtctcacgatagccagttgccaacatcaacagcgtttcgtatggtacgtcaacgaacgtaaagtctggtgtgccagtcacttgcaaccaaacatcgttatcacggagcatccaagccaacagcattcgttcagctttttcaactcgtgaaatcgttcgtggcgttggcgccggaatcggtgccggtgcattagcttgccaatctccgttcggcgcgaccggataattaggctctggtcgacggtaacccgattgacgattattcgtcgacctagggttagaacgattggcctgctgttgcagtagcaatggacgcaattgatcttgcaacgcctccatgccaatgttgaattcatcagaaatttcacgtagataagtctcacgcataacgggttctgacaccgttgcgatgacacctaatacatcacttacgtaagcaaacaactcggtttggttattcagattgcgatccgtctttaaatagcggatattaaacgcaactggatcttcagtattatgtgatagcacattcaaaaatgcactgacatcattggaacgtaaaaactcatcaggatcttgattatccggaatgtgaatcacattcgccgtgatgtgcccgttttgcgcaactaagtctaacgcacgctttgtcgccttttgaccagctgcatcagagtcataactaattgacacgttatcagccatgcgagaaagcacttgcacctgttctggcgtcaacgatgttcccattgaggcaactccgttttgcacgccagcttggaatgcggcaataacgtccatgaacccttcgaatacaaccgcgtgcttttgcttacgaattgcgcccttggcaaggtccaagttaaacaattcttgtgacttgttaaacagtggactctcaggtgaattcatgtacttcgcttgggtgtcgtcatttgacaaacgacgtccagaaaacgcgattgggtgactagcactatcacgaattgtaaaaagcacacgattcgtaaagcgatcgtgcaacgtgccatcatcccattcaatgaacaattccgatgaacgtagcaactgataatctacttgttgttcttggaagtagttaatcaacacatcattttcaggtgcgaacccaagcataaatgcatcaattgtgccatcatccaagcctcgattatgtaggtaatcaagggcaccctcacctgcctcggtattaactagcaagtggtggtacaactttgtcgcgtctgcgtacaattcacgcagcgccttaatttgtggatcaaccacttccgttgcttcgtcagatgtgtatgatgcatctaaatcaaccccggcaaatggggcaacctttgccacagcttgtgggaaggttgcattatcgatatccatgataaaactaaagacgttaccaccacgaccgcatgagaagcagtgataaatttgtttatcttcattaactgagaaagacggtgtacgctcatcgtggaacgggcaaagcccaaacagattgcgtccctgtttcttcagttgtacatatggcgaaatgacatcaacgatattaacacgttgtcgaatttcttcgaccaactgttctggaatacgtgttgcgattgtcatcacccccaactctaaaaatgaccatttccagctcttataattatacgcttgaatgcacaatatgcaagtaagtttgtcaacccccattgaaaggcttcaaccgttgataaatcaaggtttcgatttttcaattaaaatattatgtaaactaaaaagccaccaaccaaaaaccggtcagtgacatttaatagtaatgttatttgttcgctgtttttacactgcgcatgactgtgaaaaaggccaaaattgaaataatcatcaagacagttaagaaaataagtccggattgcgacccagtcacaacgccgtctccaatatgacgatcagttgccgatacaaaaatttgggcgacaatcgcggtcgcactggcaccaacaaattgttgcaaggtgttcagcacactgttaccatccgcattctcacttggtgccaggcttgatagcgtgatggtcatgaggttcgcatatgaacagccgattccgaccattaacaccatatgtgttagcatcagcgtccagaatgatagctccttaaagaatacggccatcaacaccattgccagcgtcgcaacgctcagaccaaataagattggcttaactgcaccaaatttgtccaatacgcgtcctgaaactggtgccagtacagaaccaatgaccgcacccgggaacatgaatagtccagcagcagttgctgtacgccccaaacctagttgcaagtagttaggcaagatgaatgagagtcctagcaggattgcttgataaacaaggaagctaatcattaagcgatcatagcgcgagtgacgtaaaatggctaaattcaatagttgacgacgcttgtttaagaatgcgaatatcactagcaagacgactgccccaattaggaacattagtgacagacgttcgacggccatcaatagcaatgccaatcctaatccaagaaaaacaaacgcaccaaaggcaaaactttccgttcgcttaactgtttcaaccggcatacttgtcagtcccatgattaatgaggctaccagcaaaacaatcaaaaaccagaagattgaacgccaacccaaactatttaacaagctaccgccgtatgttggaccaatggcaggcgcaattgacgtggtcattgttccaattcccatcattacgccacgtcgatcaagtggggatttcgtcaaaatgatgtcaaacattaatggtaatgcgattcccgttccaattccctggaagacgcgaccagttagcagcactaatagattaggcgcaaacccatctaaaatgacccccaccaagaataatagatttgcaataataaacagacgtcgtggcgaataattgcgaattaaaaatgctgaaagtggcacaatcactgcgatggctagcaaataaccagtcgtcacccattgcacgccgtttgcgtcggtttgaaactcattcattagggttggaaacgtaacgttcatcgatgtttcaatcaacaccccactaaaactcatgataccagccgcgattacagctcgtaacacatgccattcctttgcctgcataattccctccttaaaacaaataaaaggcgcccatcatctcaattagaaatgatgttcgcctctatgttcggcacaaataaattgtgctatctgtacgtaacaactcgtattactgtacagattttatgcaagtttgtcaaaatttttagtaattttcaaaccaaatgctaatttcgcgttcggcattttcaacactgtcagaactgtggacgatgttacgtacggcaccatcttcccaatcgcgaccataatcaccacgaatcgtgccaggagctgcctcacttggattcgttacaccagccatcgcacggaaattcttcacgatgtttgtccctgttaccaccatcgcaactaatggaccgcttgtcatatactccaaaatttctgggaaataaggtgcattgaccttttcggcgtagtgacgacgtagctgttcttctgtcgcctctgtcatcaacagcgacgtaatcttgtagcccttacgttccaaacgtgaaaagacttcccccatcaaaccacgcgcaacaccatctggcttaatcaaaaccaatgttcgttcttcagacatgtcattatcccccttgtcttatatgggttaatataccacaaattcaatttttcacacaccaatatcctgccagatgggcacaaaaaaaccagctttgacagctggttcattttttaatattaatgtgtgcgcaaatacttaactgcatcatcaaacgtcttgactggcacaattttcatgccaggcgcgtatttcttagccgttttgaccgctagttggtaatttgtcatgccgtcagattccattgccaaattggccttggttggcttgatatatggggcaaagaaaatcttagcacctgattcatgggcgactatgacctttttatcgataccaccaatttcgccaacattgccgtctttgtcaattgttccagtaccagcgattttacgaccagcagccaaattttcattggccaacgcatcgtacatttctaatgagaacatcaaaccgccagatggaccaccaatgtcgcccatatccgccgtaacttgtcgatcagacgtcacatcaactgcgtctgttagtgcaataccgataccaggtaacttcttagtcccggccaaagcaaccgtcttaccagttgcttctttcgtcttgccgttatgttgatagttgattgttagttttgagccaactttgtttttacgaatgtaattttggaatccctttgctgactcgaacgacttaccatcaaccgatgtaatgaggtccccaacgtgcaactgctttttaaaattagagttatcttgcacagccataacgtaaatcccgttaaaggtacgtgtatatggcacgtcagcagctttaaacgctgtggctttagcctcattcacagcagagtccatgtacaccttgttaatagccacattgtcagcctgagagccgccaccattcgcctcgtatgaagtcattagtgatgcagttggatcaagtaacgccataatggcaccgataccgttaacctgcgacatatagacagctgtaatcatatactcaccgtcaaccttaggcttcttgccatcaactttgatgtagccggccaggttgtctgcctcgccaggagtttcagcatataacggcaatggactaaccaatgccaacaaaactagcacagccgcaataatgccagaaattttcagccatttatgagacttcttttgtttttcagccatacgctacttctccgcaaacttttcagcaagtgcattggcaactggaccaggcaccaattcgtgtacgtcagccccaaaactaacaacttcttttagaattgaacttgaaatattttgatgctctggtcgggccatcaaaaaaaacgtctcaacagtgcccaagaagtggttcatttcggcaatatcacgctcgtagagataatcagtctcgttacgcaaaccacgcactaacgtatcagcgttgatttctttcatatactcaatcgtcaaaccagacatttcacgtacggttacgttcggcaaatcagctacggatgcctcgattagggtaatcttttcttcaggtgaaaagagatactttttcatcttgtttgtgcctacaccaatcacaacctcatcaaagagcgttgcggcacgcttaacaacatctagatgtccattcgtaaatggatcaaaactacctggaaataatacacgacgcattatgcttcccccttatattgatatagcttaaccaccgtaataccgtaatccttttctttcaaaaactcgaaattaggcaaatcttccggcaagtttgcattttgatccgtctcggccacaatcaatgcctctggtgcaatcaagtttgcggcaagaagcttctcaaggtcagcaacaatcgtttgcttggcatatggcggatcaaagtacaacacatcgaatggttgtgatcccatcaagcgttggatagctgcatctgcagtgctcttgatgacagtaaacttctctggtgctttcgtaatcgcaatattgtcgttaatcgtcttgattgctgcgaattgacggtcgaccaagactgcttcatctaaaccgcgagatacgccttcaatactcaatccgccagagccagcatacaaatccaacgaacgaccaccatcaaaatatggaccaatcatgctaaaaatagcttccttaaccttgtccgtggttggtcgggttgcatcacctgggaccgccttcaatggacgaccaccaaattctccactcacaatacgcattacaattcctcttcttcagctggctcatccaccaattctgatggatcaaccgaaaattcaaacgcctcaccttgactaccaatggttgtatcaacctcaggccagtgagaaacatcaacagatgctacgaaacccaagcgttcaatcaacgctgactttgaggcaacatcttcttcattcatatagatgacagcatacttcatcttttctgaaatataactgacaacgccaaaacgacgcaattggcgcgcttgacgaacatttttcaaataaaccacgacgcttcggcgcggcgttacttcaaaagccatttattcacgctcccgtaaactttcattctttttcaaaacaccgatcatgttaaaggcgattccaaacgtaattccccaagacatcaatgatgacccaccatacgaaatcaacgggaacgtcacaccagtaatcggtacgactccgacaacaccaccaaggttaaccagaatttggatgccgatatatgcggcgataccatacaacgtcaaacggatttgcatgttacgtgtcttcactgcgtatatcaccaaacgccaaatgataaagccaaatacagccaggataattaaaatccaagcggcacctaactcttcaccgacaatcgccatgataaagtcggtgtttggctccggtagataaccggccttctggatactattacccagaccacgaccccagaaaccaccgtttgaaatggcgtaatacgaattaatcaattggtgtcctgcatcctcagttttccaaggatcaatatatgattcaaatcgtagcaattggtagtgcatcaaaggtaatttctcaagaaccggcaacagcacaggcaccattatcaaaacgccaatcacaataccaaccatcgtaattaaaccagttggacgaatacctgacgttaagaaaatgattgccaccaaagcaaacagaattagcgcaccaccgaggtcaggcattagtgccgttagtaagataccaattccaggtgcgataaagtctttgtagtaatgaacacgttctttaatacctttgacgactttgtacggattgacaacatttcgcgcgaaacgcttggcaaaccataaaatcatggcaactttaaagtattcaaccggctgaataccaaaggttccaatgtaaatccagcccttggcacctgaggtaactggaccagcaaccagtgcgataagtaagccgatatccgttacagccaaaaataccgaaattaggtaatcaatcttggtcgacgaccagttgatgtcgacgctaaagataagcaacatcgcgctcacgctgataacgctaaagaaggcttgcttgaacaagaaggacgtcgaactccctgaattcatattcgagctagctgaatagaccatagttacaccaaagaccaatacgccgatgattagtaacaacaagaccaagtcaaggtatttaaatttctctctgacgcgtttcggcgtatctcgaatggtttcgaataatcgcccccggcgtcgttttttcacagcttgcatcgttcagggctccttcattaaagtctataacttgtattattttagcacacttccccctgtaacatttccaacttcatgaaatcacaaagaacgcccttcagcatgatgctaaagggcgttctattagtctaatttttaaaaagattagccttgttgtgcaatcttcttacgcttagcagccttctcacgctcggccgtaaccaaaatttgcttacggatacgtacgtgttctggcgttacttcggcgtactcatcatcgtccaagaactccaatgactcttcaagcgtcatatcacgtggcgtcttgattgaggcagtttggtccttgtttgatgaacgaacgttagtttggttctttgccttcgtaacgttaactgagatgtcgttgtcacggctgttcataccaacaaccattccttcgtagatgtcatcacctgggtgaatgaacataattccacgatcttcaacacccatgatagcgtaagtcgtagcttgaccttggttaattgaaaccaacgtaccgttacgacgacctgggttccagttcttaacaactggagcgtacgtctcaaacgtgtggttgtagataccgtatccacgagtcaatgacatgaattcagttgagtaaccaatcaatccacgtgaaggtaccaaccactccatacgagtcgtaccagtaccagttggctccatgttacgcatctcacccttacgttggttcaatgaatcgataactgaacctgagtactcgtcaggcgtgtcgatttgaacagcttcgaatggctctgattcaacgccgtcaatttccttgaagataacttgtggacgtgaaacttgcaattcgaatccttcacgacgcaaagtttcgatcaagattgacaagtgcaactcaccacgtcctgataccaaccatgcaccagcttcatcagtgtcatcaacacgcaatgaaacgtcagtgtgcaattcgcgacgcaaacggtcttccaattgacgggccgtcacgaacttaccttcgcgaccagcaaatggtgagtcgttcgtacggaacgtcatttgcaaagtaggctcatcaatacgcaaaactggcaatgcgtccaagtgtgatggttcaacaacagtttcaccaactgaaatttcttccatacctgaaacggcaatcaagtcaccagcaatagcttcgttgatttcaacacggtccaaaccaatgaaaccaaacaacttcgtaacacggaagttttgcgtcgtaccatcaagcttcataacagtaacgttgtcaccaaccttgatcttaccacggaagacacgtccgataccgatacgtccaacgaagtcgttgtaatccaacaatgaaacttggaattgcaaaggctcgtctgagttgtcttcaggcgctggaatcgtttcgaatacagtgtcgaagattggcttcatcgtgtgctcttgcgtagccaagtcagcatccaatgatgacgttccgttcatagctgaagcgaagataactgggaattccaattggtcttcgtcggcacccaattcgataaacaaatcaagcacttcgtcaacaacttcagtaggacgagctcctggacggtcaaccttgttaacaacaacgattggcgtcaagttttgctcgaaggccttcttcaaaacgaaacgagtttgtggcatcgtaccttcaaaggcatcaacaaccaacaaaacaccgtcaaccatacccatgatacgctcaacttcaccaccgaagtccgcgtgtcctggcgtgtccaagatgttgatttgcttgtccccaaccttaacggctgtgttcttagccaaaatcgtgataccacgttccttttcaagatcgttcgtatccatggcacgatcgccaagttcagtacgcatatcaagcgtgtctgattgcttaagcaattcattaaccaacgtcgtcttaccgtggtcgacgtgggcgatgattgcaatgttacggatgttttcgcgctttgccaaaatcctattctccttgactatacgtcacttttattactctaatcggtgtaacaactaacaaatacgagccgctgaacacgcggcccggcttataggtcacgttcaattgacatgatatcgttatatgcttgttgtgttgccactagaactgctcctgataataacatattcacaggttggtcgtcaatttttccgactttaaaccctaatgcttcaccaagcaatgtcccagcagcgtagtcccaaggcttcataacactggcgtaagcaactgctcgaccagtcaaaacatgtaagtatgaaatacctgcagaaccataaacacggtacccgattgcttgcttggcaatttcagggaaaccgtattgttcatataatagtcgtgctcctgacaaaatcacgagaccgtccgccaacgatgtattcgttggtgtgcttagttgttcatcattatggtaaaccccgtattcagggccaccgtgtacaatatcgtgattgacaacgtccataatccacgccatcaccggcttgccatcttcatagacagccaacatggttgcgaattcagcgtgttgcttcacgaagttcattgtgccatcaattggatctacaaaccaaacacgaccgtccaaactgttaaccgcatccccaaacccttcttcaccaagaatcttggcatgtggatcaaaccgacgaatggcatccacatagaattgttcagtttctcggtcaacgttcgtcactaaatcgcgatgtccttgttttgtttcgacctgcatccgttgagagacacgcttcaaaacgttatcgtggacggtatccagccaaccaagaacagttgtatccagtttctttaattgtgtctcattcaactgctagccctccattttaaggcgcttagtagacgcttgttgggctgcctgaatcgtacggtagatactgtaatctgattctaccccgaactcacgatcaagttgcttttcttcagccttacttggcacaacagttttgaagtccttgtaggccgttaaaagtgactcacgatccacgccaccttcgtacgctgcagaaacagctgagtacaatgcgcttaccttgatgatgtcatctgttgaccaaccatccagcatgggatagttaaaatttttatcgccactgaccatccggattacccaatgtaacgtgtgccgtcagattctgaccatggcgtcgtcttgctgatgtgatcgtagtatagcgtaccgtgcaagtggtcaatttcgtgttggaaaacgatggctgggtagccttccaacttcaattcttggaagtcaccgttttcgtcttgatacttaactgtaatacggtatgaacgctcaacgtaaccaggtacatcttcgtcaactgacaagcaaccttcacccattgacaaggctgtttgcttaactgattgacgtgtaataactgggttgtagattattcccttaaagaagtacgttggctcagcgtcttcgtcaatatctgagtcatcaacatcttcatcaggaatcaaaattgaagaaaattgttgtgaaataccaacttgtggcgcagccaatccaacaccaggacgaagaccgtacttttcgttttcttcttcatcttgactgatgattaggtattccatcatgttctttgtggcttccttcacttcatcagaaagtgggaacgtcacctttgcggcttgttggcgcaaaacgggatcgccatcgcgcacgatatccttcatcaaatacatagctcttctcctaccattttgtttcttaataacaagtataccaaacttaaaccggttggttcaatttacgcaaatcgcgtaagtaagcagccgtttcatcattaataacgtgggccacgtcaacgtgaagcatcggcttgcggttgtcgtaccagacatccgttacaaccaatgccatatccgtatcagaggcgctcactaaattttgatcttccgtataagcacgcaatgcattatttaacgcttgtcgcacaaccacgacttcttgtcgctccttatatggaatttcaaattcaaacgccatgacttcgtgcccccaaatgttagcaaccaacgtcgaagttgggcggttcatagggaaaatcaatagctcattcgataaatccttcaaagcaaccgccatcgcggcattcacaacttgttgcgaggcgataatttggcgttccgttaaccggcgcccgtaacgacgataaatcgtgactgcaatgacaccgagcaaaacaatcagtccaatccatacaaacaacatcttacttacctcgtgagtcacggtaggccgtaatgatgcgtgaaagtttgtgtgcaataaacccgctttgcttactatccttttcagctggcgatgtcactcgcaatgaacggaatgtcgccgataatagaacaaagtcatggtaaagacgatccgttgacgttgcacgttcaggcaaatccgtatattgcgcggctaatgaaaaatcattgtagttgcgcacgaaatcttctaatgatgtcaccagcacaaaatgaccagcttgacgcttagtcaattcaactgctgacaaaccagcaatcatcgcttggagttctgcttcgtatgcagatgagatgcccgttgttaaggtggcaacctgttcagctggttcatcaacagccaatgttacataaccagcgataccgcgattcaaattaacgtcccatagcccgccaacgtaaatatacgttgccaaatcggctggtagcgtggctttcaaactgttggccaaagcaacttcttcaggcgtcgttgttggcacatatgcgcgtttgaattttcctttaacaccacgcacattgtcttttaatcgttgccagatgctttttgtcatcactgcaaacctccgtttcattaacttaagtgtaaccgaaatacgccaaaaaaacgactggttgcttatcgacgtcatatctcatacatccggtgtgaatatggtatttaatccgcatttctgataaacttacatataagattgttcggtacaagacagtaattaaaaaggagattaaccgattatgatttttaaggtttactaccaacctactatgaagcaaaacccaaagcgtgaaaacacgcaatcactttacattgacgctgttgatcaaccagctgctcgtttggctgttgaaacaaacacggactacaacgttgagttgattgagcaattgtcagaaaaggctttggcttacgagcaacaaagcccaaactttaagttgacggagttctaatctatggtaatgaatctggatgtacgtccagacgagacagccgtatacgcattgggtggacttggggagattggtaagaacacgtacggtattcaatatggtgatgaaatcatcgttgttgatgctggtgttaagttccctgaagacgaattgctaggaattgactatgttattcctgactatacctacctaaaggaaaaccgcgacaagattaaggctttggttatcacccacgggcacgaagaccacattggtgctatccacttcttcttgaacgcagttaacgttcctgtatatggcggacctctcgccttggcattgattaagaacaagttggatgaacacggcttgttaaacagtaccgaacttcacgaaatcgatgaagatactgttcttaagtttgacaacatgagtgttgagttcttccgcacaactcactcaatccctgatacgtttggtgtggctgttcacaccccttcaggtacaatcgtcgaaacaggtgactttaagttcgacctgacaccaacgactaagcagccacctaacctacaaaagatggcacgcatcggttctgaaggtgttttgctattgatgtctgactcaacaaacgctgaacgagatgaattttcaaagtcagagcgttgggttggtaagacgattgataagttgtttgatgaaattgatggtcgcattattttcgccacgttcgcctcaaacatgtcacgtgtgcaaatggcaactgaagctgccctggcccacggtcgtaagattgctgtcttcggtcgttcaatggaaagtgccgttaccaacggtttggcacttggctacttgaacattccaaaggagatgttagttgatgcacacgaaatcaaccgcctcccacctaacgaagtgttgattttgtcaacgggttctcaaggtgaaccgatggccgctcttgcccgtatcgccaatggtacgcacaagcaaatttcaatccaacctgatgacacagttatcttctcaagttcaccaattcctggtaacacacaatctgttaaccgcgtgattaacgaacttgaagaagctggtgctaacgttatctacggtaaggtgaacaacatccacacttctggtcacggtggccaagaagagcaaaagttgatgttgtcattgatcaagccaaagtacttcatgcctgtccacggtgaataccgtatgttgaaggtgcacgaaggtttggctcacgatgttggtgttcctaaggacaacacattcgtgcttgataacggtgatgttcttgctttgacggctgattcagctcgtttggctgaccacttccctgccgaagatacttatgttgacggtaacggaattggggatgtcggttccgcagtgttgcgtgaccgtcaaatgttgtcacaagatggtttggttgtcgttgttgctaccatcgatttgaagaatcaagaaatcacggctggtcctgatatcttgtcacgtggatttatttacatgcgtgaatctgaagagttgatcaacgaaggtcgcaaggaaattttccacgctatcttgacagcaatgcgcgaaccaaatgcaagtgagcacagcattcgtaacgcagttgtatctcaactacaacgcttcttgtatgacaagacgaagcgccgcccacttatcttgccaatgtttattttgatttaacatcttactagtagaaatactgctaaagaaactaaaagttcccagccttgtggttgggaacttttttcatgtgttcagttaataaaatgtacttcaagacactatgtatcagccttcgaaaagatgccccttttttctgagaactatttcaacgataaatgaaaaatgtattggtttgtgcttttgaattccatgataatatacatttataataattaatttactgacttaaatgccttttgtaatggttaataacgtccagacaggattgacgaaaaaagcttgaggagtaggtttatgtataaacgtctaactaaattttggagcttaatgctattaagcatcattttaggaatcggttcagtggtatcttcgccgttatcagctaataattcaagtacgcataccaacacacaacagtatgagaaaaagtttaaaaagctacatctaaaaaacaaaaacgttaaacaaatcaaaaaaacgctgaagaaaaatccgacctttaaaaaagccgctatcaaagtaaccgactcaaaaactaatctattgccttcgatcgcttcgcttcatgtgaactcggcaaaagtatcaactgaaaaattcaaactagataaacaaggcaaactaaaagtcatttatctggtaaccaaaatttcacccgctaaagtcaaattagctgttgtcgcttcggaatctgccgaaagttcttcaaaacaggaagcagcggatagttcgtctcgctatgccgctagtcagtctgcctctattgctgcttcggaatcagaggctgcttctatttccgcttcagttgcttacagtcaatctattgttgagagccaatctatttctgagagtcaagccgttgctcaaagtcagcaacaagccgcacaaaatgcgaccgttacaacttctgttcaatcgccatctacaggaaacaatggtggtggtgtgcaaacaggaagccattgggaaatcgaagatggttatgattggtcaacaagacgtgggcacagtcacattaagcaacccggtgaacctcttgatcccggctatcattggcaagcttatgccggtggttaaacttgtataaatttaaaacgcctttggaattcgctagaatgagttcccaaaggcgtttttttagttcttctgtaagttttccaacaaatgttcgattggcgtcatgtcggtcatatcagtttgacgtgattcaaccatttctactaatcgttgttccgttggtgtacgctcacccatggccttacgcttttcaaaagcgtacatcaccttgagcaacattttatccgatgttgagaccttatcgatattgatcttaccacctagcagcgaaacactcgcacgtggcatgtaatcgtggacttggtcttccaagaattggattgtttccttatcctccggatctgtcatccccacaacgaagacccgttcaacaatatctggatcgaagacatgcgcaatttctggcaagcctgccaccgtgcgtcggtaaattggtgcaaacacataaaccttttcaatccccggctcagcggccagtgctggacatttatgatagtcgcacaccggtaaatccaacgccgtcgcaaaatccttggcatatgcttcggtcgttccatattttgatgcataaataacaactgcattcgtctttgacataacgatatccccctacccttattttacttaagtgtaccgctgacatttgacttccatatgcgacaaaaaagaaaagcatcagcttattttttgtcgttgttgttcgtatttaattatttgctcacaatttgcataattgttggcaactcatttacttcataagttgcttgatatggcgtttcatttacttgttgatgcagatttacccaaagcgtgtccaaattgtaacgattaccaccttggatgtccgaagccaaaccatcgccaatcatgattgactcttcgcggtccatatcttgccggtgaccaaaaatcgcatcgaaaaattcagttgatggctttgcgtgaccgattgcatcagaaatgaagacatcatcaaaatagcgcccaaagccggtatgttctagacgtaattcttgtgtgcgttgctcaccattcgtaccagcaattaatttgtacccttggttaacgagattcttcaacaaatcttccgcaccatccagcacaaaatagttttgattcagatactgacgatattcttcctcaagcgcaataccatccacggcacggtcgaacgactcaaacaacttaccgaagcgcgtgttatgaatttgatccttattgatttcaccacgctcataggcagcccaaagtccacggttaatggtttggtaggttgcgaaggcttcatcaacttggttttctagaccatgatctcgaaaaatgttcatcaatcccacttgctcgccctttcggaaatctagcaatgtgtcatccaagtcgaaaattaggtgcttatacatgttttgcctcgcttctactagttatttaaactcagtataccaaaaaagcatcagtacaagaccaatgctttagaaaaaatattatagccaaaatggatacggacgtgttgtcaccatcaaatcataggcacgcgaaccaagttcttcaccatctgcatgcccaaattctaaacgtgatgtccggacacgaattgacgctgcggtaaagcgatgcacttctgaatagttgtaatgacgaccacgtactaattgaaccagcaaccacaaaattttcatgaaaaattgtgggcgctcgatcatgatcaagtcaattttaccgtcagttggatctgcgtctggcataattttcacaccgccaccgaaatacgggtgattagaaaccgtgaacaagtacccgcgcggcgtgtaaaacttacgaccgttggcaattatttcaactggaaaacgatcctgtcgtgacaaagcttcaatcaacgcgacaccataggttgctttaccaagcttcaatttattgaggatatttttaatgcgtgaattattggcaatttcaaccgtcgtcgcatcaaatccaatcccaacattattcaggaagaaacgacgttcacgtttaacggcatccatgtattcgccaatatcaattgattttggctcaccagcgtcaacttttgtcaaaatcgtttgcatcatttctacaggcgtccctgtgataccgtgagcacgtgcaaaatcgtttcctgagcccgctggaatataagccaatgggatacttctttttgtatcaaaagcaagcaagccgttgataacttcatttagtgatccgtcaccaccgacaacaaccaattgtcgatcagccgaatcttcatatttggcatattgatatgcccatttacgcaattctcctggagctgttgatagacggctatcaaatgccactccggtacttttcaagaattgctcaacctctccccagacaaccatggattttccagaacgcgctgccggattgacaaaaaacgtgtaatgcatcttttttgccatctctctttctttttgtcattaattagtatacaaaaataaatacacctcgtcagcctaaatagtgtaccggtcacaaaatggtcgatttttatgcatataaaaaaccagaaccactacagttctggttacaatcattatttaacgccccagtatgtttccttgtaggcgtcacgcgcttgtttttcttctgagtagacatcggcatgtttcttatagaagtcttggtgatattcctcagcttcccagaaagtcgttgcctcttcaaccgttgtgacaatagcatcatccccaaaaatacctgatgcctgcagttgtgctttcgacgcttcagcaactgcccgttgttcatctgaattaacgaaaattactggtcgataattgtcaccacggtcttggaattgtcccatcgcatctgttggatccgcagtttgccagtacagcgcgaccaggtcatcataggacaccacttcatcatcaaaccaaattttgactgcctcagtatgcccagtttcatgggctttaacttcttcgtatgttggattgtctttaaacccacccgtataacccgaccggaccagcttgatgcccggtaaagtttcaaatggttgcaccatgcaccaaaaacatccgccagcgaaaattgctgtttgttctgccataataaatcccccctaatttttaatgcattacttcaacttgatgtcccaagcagcaatttcagctgaaccatatagttgcttcatgtgcttcttagttgattcagtttggtaagcctttacaacttgcttgtaaatcttcttgttttgcgttcccttacgtgctgcaataatgttgatgtagcccttgttagccttgttaactggctcgacgtacaacgccttgtcgatgtccaacttagcatccagcgcatagttagtgttcacaaccgcagcgtcagcactcttcaaagcagacgctgcttgatcagatgcgacttctttaatcttgaaatctttcttgttctcagtaatatcctgcgcgcttggcaacttcacgtcgtggttgtacttaatcaaaccggctgcttcaagcacatccaatgcgcgcttttcgtttgaagggtcgtttggtacgacgattgtaccgccctttggcaaatcagccaaagtcttgtggttatctgaataaatgcgaattggtgtcacataggtcttgtcgacgcttaccaacttacccttaaaattcttgttctggacatcgaagtaattaattgtttggaaggcattcaaatcgatcgacttgtcgaccaatgcttggtttggcttgatatagtccgtgaacaactttagcttaatatcaatgccgtacttcttggctgcatcttttttaacgtattcccacaattgacggtcagagtcacccaccaaaccaaccgttacagtcttttcctttgaagctgcagacacatcatgtggttgattagcaaataccgccaatcctgccactgcaacaaccgttcccaatacaacctgcttctttgaaattcccattttcatatcctccataaacctcagctttaaacaaaaaagcccgtttctatacatcaccctaaaatagggctagatatagaaacggacttaccgtgataccattctaccttcatcatgccagtcacccgacatgaactcacaacgtgcagacagggagcgagatgatgctgtgtcgatacgcgtgtctggtaacggagaccaatccgtgtggtatttacagacttgctgctcatgccacccaatcacaggccattttcatcattaattcgcacgtaccgtcacaccgacccgatactctctagactttgaatcaatcattactttcctgatcactttgtttttaactgtcgttttttctttatgagcattatattagcgttttctcattttgatgtcaacgcttttttagaattaattttcattaaccgctttcaacgcagtcgcaccaacgaaattaaccggttgcgtgaagtttggttggaagaagaaatcggccatcgccaggtcattaatcgtcattttgttttgaatagctagtgacacaacgttcgctgcctgagaaatgtcatgttctgacataaaggccgctcctagtacacggcgtgtcgccttatcccacgtcagcgttgataagaccttagttgttgaaagcatgaaatcaggtcggtaatcttcctcataaacggtttcttccacttcaatgccacgtgctgccgcactcgctttattcaagccggtccccgccattgcaaagccgtaaagttcaactgctgacgtaccttgtgtccctgtgtacgccaagttatgaccatcaatattacgggcaactaacataccttggcgaatggcattggttgctaatggaatgtaatcgactgcctcggttgggttatagaagaccgtcgtggcatccccagctgcatatacatcaggcacactcgtttccatatattcgttggtcttaatggcgccgtttggcaacatctcaacttgaccttggaacaaatccgtattcggcaggaacccgataccaagcacagcgatatcagcttcgtacgcgcccttgtccgtcacaacccggatgccaccatctggcaactcttcaaacgctgccacgcgttgtcccaatgccaacgttacaccgtgttcaacaaacgctgcttcaagacggtctgtcataaccggactaaagtttttcggcaacacacggtcaagaccatcaaccaatgtcacttccttaccggtcactgagaattgttccgcaatttcagcaccaatgtaaccagcaccgataacaacaacgcgcttcaagccatcagcaatatctttaatccggttagcatcttcccatgacttcgcgtaataaacacgatcactgtgaatacctggaatatttggtactaaaggctttgaccccgtcgtaatcacaatcttgtcgaacgtctcagttgtgatctcatccgtcaccaggttcttcgcacgaatttgcttgatattcaaatcagcttcaaccacttggtgttgcatcttcatcgtaatgccttgagccgtcattgactctggtgattcataaaacatacgttgctcgtctgacacgtggtttcctagccaaagtgcgataccacatgacaaaaatgaaaccgtcgtatgttgctcataaaccgtaatatctgcatctgggtgcagcttcttgatttgcgtggcagaaaacgtgcctgcgtgtgtactaccaataattgctattttcatgttatgattccccttattttgctttcccttgtgcatttgcaaaccagccattaaacaataacttcacaataggtcgcgaccccgttgtttcgcaaaagaaacacccacatgttccttttaacagcttgttattgtccgataattaggtattgcacaaactaatagtaacaaacttcacaaaatagtcaaacctttttcgaaaaagaaattcaaaaaacgtccgagatttctctcggacgctcttattaatgctatttacttaaaccagctatcaacctgcttttggtgagcagcaatccaatccttggctgccttctcaggtgacttgccgttttggatggctaacatgactgactccatgtcttgctcatcccacttaaacttatctaacacacggtaggcctttggcttatccgccttaagacccttgcgcgtgaacgtattgattgattctgacttaccaaatgaccccttcggatcagacaagtacttcaaatcatacttttggaacatccagtgcggtgtccaacctgtcacgacgatatcttgcttagccttaatcgccttaccaagtgccacagtcatggcacctgatgatgacggcgttatcttccagccattgttggtcaaaccatagtcagccattgccttttcagcggcgttggtaacacccgcaccaggctcgatacctgttaccgtcttattggcttgtgtcgttaaatcactaatgctatcaacatccatgtacgctggcacaaccaaaccagttttagcaccggtcaagtttgggcctagcatgtcaatttgtgacttgtatttcttatattgtgcagcgtgcgtattaggcaaccaagcagacactgatgcatccgcttgaccattagcaactgactgccacatgattgaattatcaagtggcgtcaaattaacgctataaccgtgttgacgcattgcttcagccaacacgttacttgatgcaacttctgagtcccattgcacatacaccaagttcaatgtatcttcagccttcttaccattggcaaaggtgttcacaacccctgaaccgatcatcgccacagcgactacaatcgccgtccacatcttccagtggtgctttgaggttggttgcttgtcagccggcttgacgttcaatttttgcgtgaagcgatcaatgatgatggccaagataaccaaagccaaaccattcacgaatcccttaccaacatccgcgttttgtacggccgacaagacaccacgaccaagtcctggcgcaccaatcattgacgcaatcacaaccattgacaaggccaacataatcgtttggttcacaccggccaaaatcgtatttgttgccaatggtaattcaagcttaaacagcttttgcttaggcgttgatccataagaatctgccgcttcaaccaaatcctttggcacttggcgaatacccaagttagacattcgaacagttggtggtaacgcaaaaatcacggaagcgaaaacaccaggaaccaccccgataccaaagaaagcaaccgctggaatcaaataaacgaaaccaggcatggtttgcataaagtccaaaaccggttgaacaatcttagcaaccgtttccttcttggccatccagatacctaatggcacaccaataatgattgagaccaaactagacaccaagaccaacgtgaaggtgctcatcaaatctgaccacaaattttggttggcaatcaggagcaatcctaagaaggtaaacaacgggaagccccacttcttgccgcacactagtatggcaaatactgtcaagccgatgataaccatccagcttggcatagccgttaagccgttagtaatgccgttcattaagtgagtaccaccatcctgaatgacattaaagaacccactcaaagtggttgttaaccaattaacggcagattcaacccaatttgcaattggtaatttacttattaacactgtattcatcggttattgcacctccgtttcagacaacgcttctaggacacgaccacgaatgataacgcccagcaaacgcccgttgtcaaccactaccagtggtgtcggtgcgtcataaatcaatggcatgatgtcggcgaccaacatatcgcgggcaaccgttggcatttcagtcatcacatcacgcaacccgatgttttcgcgacgagcacgtaaagcatcttcactgctaatgaacccctggaattggcgacgacgatcaacggcaaccaacccactcacctcttcggtacgcatcttcttcaaggccactgccgggccgtcaacgtcgatgttagtggtaattggcggaatcataatacgttcagccgttaacacctttgaacggtcgacgtcttcaataaacgcacggacataatcgttagccggtgccgtcaaaatttcctctccagtaccgacttgttgaatttgcccatccttcataatggcaatgcgatcaccaatacgtagggcctcgttcaagtcgtgggaaataaagataattgtttgactatcattcgcttgcaaatccaacaattcatcttgcatatcacgacgaatcaacgggtcaagtgctgagaaagcctcatccatcaataagatttcagggttattagccaacgcacgggccaagccgacacgttgctgcatcccacctgacaattgatttggatattgatccttaaacgccaacaaattggcattatcgagcgccttttcagcgcgttcgcgacgttcttcctttggcacaccttgtacctcaagaccatactccgtgttctctagaattgtacggtgtgggaacaagccaaaactttgaaagaccatactcattttcttgcgtcgcacttccaacaattgttccttcgacattgtggagatgtcttcaccatcaatcttaattgaccctgatgtgggctcaattaaacgattcaacaatcgaataagcgttgacttacccgatcctgataatcccatgatgacaaaaatttctccttcttcgatggacaagttcgcgtcatagaccccaactgtcgcacccgtctttttcaagatttctgttttagacgcttgttgctgaaccatttgcaaggctggcttaacgcgttttccaaaaatcttggtaagatgttcaatttccaccttagccatatcttcatattcctcctacttgatcgaatttctctcactttcgataagtgacaaccctattttaaacatgaagttgtcacttgcgtcaaatttgtttatgtagaccagcgcgtaccaaaaacgggacacgccccaatttgataggcttacaagtaggtctaccaattatttatgtcaggctctgattaacgcattattagtgaatatgatatgcttatcttaattacgtattctagatttggagggatatcatggcagactaaagcagcctcgctatcgggtgattgcattacgcatcgctgaacaaattagcgctaaccaactcaaggtcggtgaaaaaattcacgcccgttcaactttggccacgacatatggtgtgtcatcagaaacagcccggcgtgccattagtgtgcttggtgatctgggcattgttgaaaccatgcatggcagtggcgctaaggttgtttcccgccagaaggcccaaaagttcgtcgagagcgaaacagaggttaatgggttacaagacctgcaaatctctcttacagagcaaattaaggcccaacaagccggtttggatgccttgagtaaagatttacagcactttgttgatcaatcacagcactatcagcagcacaacccgttaaccccctttgaattagagctcaccgagccgtcaattttattcgataagtctttgagtgaactgaatttttggcaccaaaccggcaccactttggttggtatcgcccacgaagagaagttagttatctctcctggcccttacgccaaaattcatcaaggcgacacgttgtattttgttggggatgaaaacagcgtgcagaacgtctataacttcttttacagcaattaaaaagacgagcaagaactaaattcttgctcgtcttttgttttactattaattatgcgttgaacgcgtcagtaagtggtggaaccacttgcttcttacgtgaaacaacacctggcaatgaagcacggccatcagccaacttcacgtcaaaggctgcttcaaccttgtccaagttgtcacccaagaccaagatatctgaatctgaatccaagatgttcgttacaacaaagacaaacgtgttgtagccttcttcagccaattcagcttccattgcggcaacaacttcatcacgacgtgagaagacatcttcaacgtcaaccgtgttaacttgaccgatgcgaaccgttgaaccattcaattcgaatgactttgcgtcgccgtcaatcaattccttagctgaacgtgatgacaagtcagtaccggccttcaacatttccaaaccgtatgcttcgtagtcttccaaaccagcaatctttgccaaagcctccaaagcaggcttgtccattggcgtcgtcgttgggctcttcaacaacaaagtgtcagagatgatagctgatgccatcataccagcgatttctgcaggaatttcaacgttaagcgtttggaattcgtagtacaaaacagttgctacagaaccccaaggcttgttaaggaagtacaaaggtgcagctgatgagaagttaatcttgtggtgatcgtatacaccgtaaacagttacgtcagcaatgttagcaagtgattgtgcggcctcgttgtggtcaaccaagacaacttcttcagtgtcagctgactcgattacgcgaggagcgtcaaccttgaagtagttcaatacgaattgcgtttctgcgttaggcgtacccaaagccactgcttcagtgtcttggttgtatgccttgttcaacaagtatgacgcagcgaatgctgaagcaatcgtgtctgtgtcagggttttggtgtccgaaaaccaacatcttagccatcagataaatctccaatttctttttgttatttcaatgtattaactatacaacatttttaaggtgtaggcacgtaaattggtaaaaaagtattggttatatcaaaaaaacacaccgtcagcacagtgctaacagtgtgtttaatgattaattcaaaaccaatggttgcacataagcgtgcatgcgaactggcgtaccagctgcttcgacatcaatgataaagctaccattactgtaacgttgtcccattgggtgatcctttggtgaaatatcgaattgcttatcacgatccgtcatcaccgttaacggcgttggttcatgtacatcaacaaccatcatcgctgcaatgcgatgtggatccttcttcaactcacgcataatcgcaacacccttgcgaccgcgactagttgctgaaatttcagtaaccggcatccacttgaatgcaccgcggtttgaaacaaccgcaatcgcttgcttatcagttgcaacggccattttaaccacacggtcacccgcttcaaggttcattgccttaacaccagccgtacggttaccagtcgttggcacttcgtcgagtgagtaacgtagtcccatggcattttctgaagccaacacaaccgacttgcccactagtttcttatcgtcaatcaattccaagccgacaacggttgcgtcgtcactcttcaacttgattaacatggttgccttcttcttgtacgtgctacgtggcgctaaatcggcaaacggcgtacgcttaatcaaaccatcgcttgttgccacgacccattcaccagccatgttatcaacagatgacataatacgcacatcaatcacaacttcatcattggccaagccagtaattgtttgtgacaagtgctcaccagcgtccttccacttaaattctggcaactcgtggactggacgataaatcacattacccttgttcgtgaagataaacgcatgttgtagcgtattaaccttttcaacaaagaccggttcgtcatcatcacgcaaaccattttcatcaccagatgccgtgtaagaacgcactgaggcacgcttcacgtaaccagcacgtgaaaccaacatcacaacgtcttcatcagcaaccgtaacggtttggtcaatcttaagctcttgtacttcagcctcaattgacgtgcgacgtggcgtgttgtattccttctttatggcttgcaattcagccttcaagaccttacgcaacgccttagggtctgacaaaatttcgttgtagttcgcaatcttgttagccaagtcttcaaactcagcttgcaattgcgtcacgtcagtattcgtcaaacggtacaattgcaacatcacaatggcttcagcttgaggctcagtgaagtcatagctatcgatcaagttttgcttagcgtccttacgatccttagaaccgcgaattgtggcaatcacttcatccaagattgaaagggccttaatcaaaccagtcacaatgtgctggcgatcttgtgctttcttcaaatcgaattgcgtacgcttcgtaataatttcaacttggtgctccaagaaggcttccaaagccgtcttcaagccaacacgctcagggcgttggttgtgaatggcaaccatgttgaagttatacgtcacttgcaagtctgtcttcttgaacaagtaagacaaaataccttctgcattagcatccttgttcaactcaatagcaattgacaaaccttcacggtcagattcatcacgcacttcagtgataccggccacatccttgttcaaacggatttcatcaatcttcttgaccaaggcagccttgttcacttcgtacggaatctctgaaatctcaatttgagacttgccacccttcaatggcttaatttcggtctttgaacgcacaataatgcgaccacgaccgttttcataagctgatcgaataccatcagcaccttggataataccacccgttgggaaatcaggtccctcaacgaattgcatcaaatcatccaaagacgcctttgggtgcgcgagcaagtaaaccaaagcatcgattacttcacccaagttgtgcggtggtatatccgtcgcataaccggctgaaattcccgttgccccgtttaccagcagatttgggaagtgagctggcaaaacagttggctcgtactccgtatcatcgaagttaagtaccatttcaaccgtgtctttttccaaatcgcgtagcatttcaccagcaagctttgacaaacgtgcctcggtgtaacgcattgcggcaggcggatcattatcaattgatccattgtttccgtgcatttcgattagtggtgcacgcaacttccagtcttgtgacatacgcacaagagcctcataaattgatgagtcaccgtgcgggtggaaattacccatgacgtttccgacagactttgcagacttacggaactgcttgtcataggtatttccatctttgttcatcgcatacaaaatacgacgctgtacgggcttcaaaccgtcacggatgtcaggcaaagcacgttcttgaatgatgtactttgagtagcgaccaaatcggtcacccatcaccgcttctaggctgagctcttgaatgtttcctacttcaaccattcagtttcaaatcccttctagtcttgccaagtctcaatgactggcgcaacaaaatcatcttcagcctctgctgtctcagcaacatctgcatcatcttctagcagcgtgtttccttcttcagccaaggtaaaggcaacgttggcttcaatccacttacgacgtggttcaaccttatcacccatcaacgttgttacgcgcttttcagccaacatagcatcatcaattgtgacacgaattagcgtacgttgggcaggatccattgtcgttgcccaaagttgctcagcgttcatttcaccaagtcccttgaatcgttgcaatgtgtatccgcgaccaatcttcttttccgcttcagccaattgtgaatccgtccaagcgtattcaattgactgcttcttaccagttcccttacgcaacatgtatagcggtggcaaagcaatgtaaaccttaccagcgtcaatcaatgggcgcatgtacttgtagaagaacgtcaacaaaagtgtttgaatgtgtgcaccgtcatcatccgcgtcagtcatgataataaccttatcgtaattagcgtcatcaacgttaaactcaggtccaaccccagcaccaatcgtatagatgatggttgaaatttcttcgttcttcataatgtcagccaacttggccttttccgtgttcaagaccttaccacgcaatggcaaaatagcttggaacttacggtcacgtccttgcttagctgaaccaccggctgagtcaccctcaaccaggaacaattcattttgggcagcattcttagattgggcaggcgttagcttacctgatagcaagcgttccgtcttccccttcttcttacctgaacgggcttcttcacgagccttacgggcagcttcacgcgcttcacgggcacgcaatgccttacgaatcaagctttgtgagaattcaccattctccatcaagtagaaaccaagttgttcagaaacaaccccatccacgattgaacgggcttcaggtgttcccaacttgtccttggtttgaccttcgaattgcaacagctcttctggaatacgcaaagaaataaccgctgaaagaccttcacggacgtcagaaccttctagattcttgtctttatccttcaacaaattaaccttgcgagcgtattcattaaacgcctttgtccaggctgaacgcaaaccagcttcgtgagtaccaccatctggcgtgcgcacattgtttacaaatgacatcgtcgtttctgaataaccgtcattgtattgggcagcaacttcaacctcgacaccttgggcaaacccatcaaagtacatgatgtcgcctagcgtgtctttgtcttcgttcaagtagctaacgaacgccttaataccttctgggtagtggtattcttcagaacgttcttgaccagcgcgctcatccgtcaaggtaatcttgacatcacgcaacaaaaaggctgattcgcgcaaacgttcggccaatacgtcgaagttatagattgtcgttgaaaaaattgcaggatctggcttaaacgtcaccgttgtaccgtttgattcctttgttttccccaacttgttcaacgtaccgtcaggatgaccaccgttaataaagtgctcttggtacttttgaccgtcacgtacgatggtaactgttaggctcgttgacaaagcgttaacaactgatgatccaacaccatgcaagccaccagatgtcttgtaaccaccttgaccaaactttccaccagcgtgtagcactgtcaaaatgacttcgggggttggctttcctgaagcgtgcattccgacgggcataccacgaccgtgatcgacaactgtaatcgcgttgtcggcatgaatcgtcacgttaatttcatcaccaaacccagccaatgcttcatcgactgcgttgtcaaaaatttcataaactaagtggtgcaagcctttgccatcagttgaaccgatgtacattcctggtcgcttgcgaaccgcctccaatccttcaaggactgtaatggaatcatccgaataagtattcttgtttgccatggacgcttcccttcttgcttttttaatctgtcgtcttacgtgaaaaatttctttttcaaagcgttccattcttcataatagcccaacaaaggctctagttgcaatagtgttaaataaatttaaaggtaactggtgtttcaatcgtggtaatatattaactgttctgttatttgaaacagatagcaattattctatttaatactattttataaggagtattcatcttgacggtttttcattttgtcataagttttttgttggcctacttttttggatcaatgccattcggttattggattggcatgttgttctataagaagaacatcctaaagcttggctcaggaaacatcggcacaaccaacactttccgtgtgttgggtacccgtgctggtgtcgccgtactactacttgatatcttcaagggatcagttggtgccctaatggcgtacatctggggaccggcgcccgcttggacagttatggttgtcggtcttggcgccatcctcggtcacaccttctcaatgtggattggcttcaagggcggtaaggccgttgcaacctcaatgggtgtgctattgatgtacaacccaacgatgtttgtaattgcgtttgcgattttcctaaccgttatcttgctaaccagtatggtatcaatggcttcaatgattgggttcaccctggttacgttgctatcaatcttttggttgcacgattggttgttatcaattatcgccttcgcgttgacgattttcgtcttctaccgtcaccgtgaaaacattgtccgtattaaaaacggcacagaatcaatggttcactggggccttggttactggcgcagccaatcaaaaaactaaccacaactattcaacacaagcacagctacaactcgtagttgtgctttttattatgcaccctgtgccaatatcataataaaaagccctgctatcaaatagcaaggccaaataaattgctaattagaaaaatgttagtgagtatgaacccgtgaatgtttgggctggtgcaagtgtattaataccaaatttgtgacgcaactcaccgtcggcatcaactgtgtccgcaattccccaccatggctcaatcgccacaaaaggtgcttccttggcatatggcgtccaaacaccaacatacttggcgttttggatgtgcatcgtcaccccgtgtgattcgttcaactttgccaaaacgattgaaacgggattttgatccaagcgcaagataattgcgtcatccttgtagtcatcacgacgcaaacgcaacggaatacgtgagtcaaacgttgattccaagttattgtccaagtatggaccaaccagctttgcacgttgatacttacgttgtggctcaacattgatgtagtaatccgtgaacttctcaccctcttcaagtggggcccggaagccagggtgtccaccaaccgagaagtagatatcgtgcgtgtccgtgttcgttacaacgtacgcaattccaagcgtatcttgctctgttagacggtacaaaacgtcaaattggaagtggaatggatagattgaaaatgattcgtcattatcaaaaagtcggaagcgggccgttgtagcggtcttttcaaccaaatcgaattcattatcgcgggcaaatccgtgttgcgccataaagtacgtcttgtcacgatacttgtaacggtcaccacgaaggcggccaacaaccgggaacaaattaggtgcgtgacgaccccagaaattaggatccgccgtccacatatattccaaaccactttccttgttcgtaacgctcgttaattcagctcccatttctgaaataacgaccgtaatattatcattctctaacttgactgacatgccactctgcctcctgtaagcgttttccaatatgtcaattataacaaattcgagcatgcttttctattcaagaaccatgaaaaatgtatgcaaaaaaagaggcttacctgtgtaagcctctttttcagttactcagttgcgcgtgggaaaaagtcacgataacttttctgcaacgcatccgttgtaacgtgagtatagatttgcgtggtgctcagactactatgaccgagcaactgttgcacggtacgcaagtcagccccgttattcaataaatcagtggcaaacgtatgccggaacatgtgcgccgacacaacctgcgtcagccccgcttttttggcgagctgtttcaggatatactcaatcccactcgtcgtcagtgcttgtccgcgttggttcacgaataaggtatcgtgtagtgtgtctgattttgccagtaaggctggccgggcatcggctaagtaaatcgccaatgcatcagccgcatattgaccatacggcacaatacgcgtcttatttcccttaccagtaatcgtgataatacgagcttgttggtcaatcatccccaacgtcagccctgcaacctcagaaacacgcgccccggtaccatacaaaatttcaagtaacaaacggtttcgtatgcctaagagactggtgtcccccatcacaacttcgaacagcttgtttaactctttttcgtaaaaataacgtggcaagtggcgccccgccttcttcagttgtacaccagcaaatggattactggccacaaattcgttgcgttccaagaactgataaaaggcacgcagcgaactcaccttacgggcaattgtccgactcacatcacccttttcataaagagctgataagtaaacgcgtacatcatattgatcaacggctgtaatatcaaccgttttctgatctccggtctcaattaagaagcgttcaaactcattaatatctgatcggtaagctttttgggtgtcatctgaatactggcgttcaacacgtaagtagtccaaaaacaacccggttaatttcgccgtatctgccatccttatgccttctcagtttcttgcttctcagccttgtctgaagattcttcgtcatcctttggcgttgtaccatcggcacgtgtcttttcagttggcttgtcccatgacacaaagtcacagtctgggtaacgtgagcaaccgtagaacgtacggccacgcttggtcttgcgttcaacgatttgtccgataccacacttagggcaacctagaccgatttcttcaacaatcgtttgcgtgttacggcaatcagggaagcgtgaacaagcgtagaacttaccatagcgacccatcttttcaagcatcggtgcgccacagacatcacagttaaagccagccaagcggtccttcaagacaatcttttccatctcaacttcagccttttcaagctcttgtgagaatggcttaaagaagtcatcaatgaccttcacccagttttccttaccgttttcaacgttgtccaagtcggtttcaacttgggcggtaaacttgatgttcgtgacatcagggaagaattcttgcaccgtattttggactaattcacccaattcagttggcacaaacttcttcgcatcaatacgaacgtaaccacgcttttgaatcgtttcgattgtggcagcatacgttgatggacgaccaacaccattctcttccagcgccttaaccaaagcagcttcggtgtaacgggcaggtggttgcgtaaagtgttgttctggtgacgtctttgccatttggaccaggtcacctactgctagttcaggcaacttgttatccttctccttggcagctgggtaagccttagtaaatccagcaaacttagtctttgaaccattcgcacggaacatcacaccgttttgctcaatggtaacagccatcgtgtctaagatttctggcgtcatttgactcgccacaaaacgtgaccaaatcaattggtacaacttgaattgatcattcgtcaacttatccttgattgaagctggtgtgcggaagacagatgttggacgaattgcttcgtgggcgtcttgcgcaccttcctgctgcttaccttgtaccggcttagttgccgcatactcagcaccgtattcttcatggataaatgttgaagcgtcagccttggcgatttcagaaatacgcgttgaatcagtacgcatatatgtaatcaatccaacactaccttctttgccacccaagttgataccttcgtacaattgttgcgcagccatcattgtcttacgcgtacggaagttcaattgtgtgttcgccgtttgttgcattgttgatgttgtaaaggccggttgtggtttacgcttgcgttcctttgcctcaaccttcgtgatatcaaagtcacccttttgatcaaggcgcttcatgacatcttggacagcatcattgtctggcaattcagtcttcttgccatcgacaccgtaaaagacagccttaaacttcgtcttatccttcttgaattctgaatccagcgtccagtattcatctggttggaaggcttgaatttcgttctcacgagcaataaccagtcccaacgcaacggattgcacacgtccagctgacaagcccttcttaaccttcttccacaagattggtgaaatagaatatcccaccaaacgatccaggacacgacgtgcttgttgtgcatcaaccaaatccatattgatctttcgtggttgcttgaaggcatccttaacagcatccttggtaatttcattgaagacaacacggttttcgccggcgtctaagtccaaatcaagaatgtgtgacaagtgccaagcaatcgcttcaccctcacgatccgggtcggatgcgaggtaaacgtgcttagctgccttggcttctttctttaagcccttaattacatcacccttaccgcggatgttaatgtacttaggctcataattattttcaatgtcgacacccatcgttgactttggcaagtcgcggatgtgaccaatacttgcaacgaccttataagaacttcccaagtacttttcaatcgtcttggcctttgatggtgactcaacgataactaggttcttctttggcttagccttagacttggtctttgaagccgtcgcacgcttcttcgctggctttttttcagttgtttctgccatatgcgtggacctctttctttcaaatttattgttttctactatatatagtaagtattatgctttaacaattatgtactatacactaccagtctagactttgacaaataacaaccgtttcgtatgtgcaccatttaacaaattcagaaggaattgttgataatatttgcaggtgttaatgccggtattgcaccggctgcaattaacgcatttgtaccgcctgaaagcatcgtatcaattcggcctggtactgcataaatatcccgatttgcatctaacgccagattggccgtgataagtgaaccggagcgattttttgcttccacaaccaggcatgccgcacaaagtcctgcgataatccgattgcgttctggaaactgatgtttagccggtccgacccagggtaaatactccgacacaacaacgcctgattcaacgacttggctttgtaagccgtcgcgacgacgcggatacgcaacctcgaggcccgtcccaatgacaccaaccgtcgcgccatggtgcgcaagcgtttcacgatgcacagcttcatcgataccggtcgctaacccagatatcgtaataatgcccgcgtccacaaaagctggcacaaagcctttaacaatttgttccccatacgatgacatttcacgggtgccgacaatcgcgacacccggatagcgcgcaaataaaaaatccccttgataaaacaaaaccactggtgggcaatcaatttcagctaaccaagttgggtattcttcgtcagcaatcgtgacgtaatgggtcgttttaagtttttcgaactgccgtgtcgcaacatctgattggcaaaaaacacgactactagcacgctgttgttttggcacacctgccaattggtgcacctcttggagcgacaactcgtttaagccatgcaccaccatgtactcccacaccctcgttctaccaacaatcccaactcctgggacaagtaataaccataataaaaaatcacgttgtttcatagcaccctcctagtaagaaagagttgcaacaacgtgatttttccatttttagtctaaataatttttaaccggcgcaaacgttttacggtgaattggggtcaccccgttcgctgccaagccagccaagtgttcagccgtaccatagccagcattatgttcaaatccgtaaccagggtaatcgaccgcgtaagccaccatcaattcatcacgaaagttcttcgcgagaatcgaagccgccccaatcgaaatactgcggtcatcccctttaatcagcttttcttgtggcaacggcaaatcaactgtcatcgcatcaatcaaaagcccgtcaacttgtactgataggttttcaatggcttgcttcatcgccacgcgtgatgcctcatagatgttgatatcatcaatttgttctgcatcaacaaccccgaatgcgtaagccacaactttatctttaatatcttgatcaagtgacaaacgcgccttttcagacaactgctttgaatcatggactgcaattaaatcgaatgaatcgtcaatcaccgcagctgctgcgacaaccggcccggctaatggtccacgaccgacttcatcaacccccgccaaaacaagaccattctgccaagcgtcacgttcaaatgttagccgctccgaaaaagccttggcttggtcagcctttttggccaatcgtttgtcataactagctaacagtttctggaccccagtccgttcgtctgtacgccaaatagccaactgttcgggcgtcacatcgccttgcaacgccgtcttaatagtcgcgatggtttcaggcttggtcatcttgtacaactccgatgttgtcctcaggcatttcaaccgtgtattcacccaacttaccacgacgcaaatcaatcaacaagcgttctgacgcacggtcgtaatcgtccttgaagccaagcttttgcgtgattagcaacaacagctcaacgtccgtgttattctcccaagcgtcttctggcaagtgataacgagcaataatggcagctgggttatactcacgcatgaactttaacgttgccaaggcaatatcgtcttggttaatcaattgatccttgatggcacccgtcattgccaagtgttcaccaacacgttggtcctcaaactttggccaaagcacacctggtgtgtccaatagctccaagtttgttggtgtcttcaaccattgcaacttcttcgtgacacctggacggtcaccagtaatggcaacattcttcgtcaccaagtggttcaaaagtgttgacttaccaacgtttggaataccagcaaccaacgcacggatcggcttgtccttaacacccttttcttctagggcagcccacttgtcagccaacaccttacgggcagccttcgtcatgatttgtggcgtcttgtgaccacgtgtgtccaaggccacaacttccatcccctgcgcctcgaagtacttcttccaagccttcgtgcgttctgggtcagccaagtcagtcttcgtcataaccaacaaacgtggcttttgtcccaaaacctcgtctagttctgggttacgtgatgaaactggaatgcgggcatcaaccaattcgaacacgatatcaacatactttaaattttcgcgcattaggcgaaaggctttggccatgtgaccagggaaccattggataatttgagccataatgttcttcctttcggtactttatgtatgacggcatgaaccgccttaatcttctgaagctaagtagcgcgtccacgcttcgtcaaacactgacatgctgtgtaggtaagacgcgttttcttctaagtagcgtgacaattcatcaaagtcttctgcttgcttaggaaattgttggtcgtaaaaagccgcattcgcaaacgtctgaacttcatcaaaggtcatcggattacgttgggtcatcaaccatgaaaaaaatgggcgtcgcattatttgctatatcctccacggaataaaaacttgtccttagctggatcaatcgtcaccgctttcacgcgcataccctgcacttccggcgcttttccaagatcaatcaaaatcgtttgttctgatgtgtcgatggtcaaccactttggtaaatcgaccatgttaccaagataccccataacatacttaacaggcaatggtaactggccaactgccactgacttggcgtgtagcaaaataccgccattcttagtcacttcaggcaccatcttcataccaaaatcaacgttttgccccaggagcttgtacgtaccatacaccatcatcccagactttgtcatctcaaaacggaatttgtctttcaatgccggatcattatttaggtactgctcaacaagggcgttcagttctttacgatcaaccgcaactgtaaatgacgcttggccaatttgtggctttgtatcagtcacctcagttcgatcttgtggtaacagaatcagcacaatcaccagtgccaccaaagcaaccaatgtgataccaattccagtgataattccttggacacgctcacgagatggcattaccactccgaagcgtgtcactttacgtggttccatactatttctccaaccaatcttcagtgtgctttgccattctcttcaccagcaatgcactcattttgtcatatcctttatcatttggatgatagtgatcaagcgttgtaatataatcattcaactctttatcactcttgccattcaatgtatccgtgaccatctcattatccagtgagccacgatttgctttttccgcctcggtaactaactttttacgggcagctggtgtttggtattgaccaaacgttagcgtattaaatgttgacacataatacacacgatcatcagccgaagctaagttagcattaataccattataaattttgacatcctcattcaaatcagaacgattagccagataaacatatagtggattgtaattaccgaataagaatatgggtgcgtcaggatttttcttttcgagataattgatgagtgtcgttaagttttcagtgtagtccggcatactagcggtgaccttatccttgactgctcgctcggacttcgcaaaaatcgctttaaacagcgtttgttgcaaatcattaccgccaactgtcatgactaacacatcggcggatttaatgtctgaaacagcctgtttattctttttaacacgcttcaatatttgatctgagcgatcaccagctttaccatagttagccgtcttaactttaacatcatacttatctgccaacaatttcgccgtgcgcttggtgtaaccttgttgcttcgtggtgtcacccacgccttctgtcaaggaatcaccaaccgccaccaatttaatggtttgcttgttagcagcataagccggcacgctggcactcaaagttccgaaccctgccactaacaaaaacgtcgcgaccatcactttaaatttgcgttgcacgctgctcacctccttaacaaagctccgacttaccattttaccatagaaaaagcgttccgcccggggacgaaacgccatttttttgctactttacttggtaactgaaaccaattgcgccagcaccagtgtgcgttgacacagttggtgacgtttgttgcacaacaatcttgatatccgggaagatttcgttaaccttatccgccaattcttgtgcctcagccggaataccagcatgagaaataccaattgcttcgataccgtttggtgcagcttgcatttgctcaacaatgctcttcaagtaggcacgcgttgacttagcaccacgccccttaacttcaacattgatgttaccttgctcgatgtgggcaccaatcttgatgttcaaaacaccagcaatgaagccagctgtctttgacaaacggccacctgcaaccaagttatcaaggttagacactgtcaaatacaattgcgtgttatcgtgaacgcgcttgatttctgccaagatttcttcctttgaagcgccttcagcggccatcttagcagctgccagcacttggaaaccaagggcacgatcgataaagtctgaatcaaggaccgtgatgtcaccatcgaccatcatggcagcttgacgagcagcgtcagccgtacctgacaatcccttcgtcaagtgaatcgaaatgatttgcacatcgtctccgaccaatgactcataaacttctgtaaacacacccaatgaaggttgtgacgtttgtggcaaattctcagccgccgccatcttatccatgaattcaaccggtgacaatgtcacaccatcttggtagaccgtgccatcaatcataattcccaaaggaactacctttacaccgtattgtgaaacttcttctgccgtcaacattgctgttgagtcagtgacaattttaacttgggccatgttcttaattccccgtttttgtaagtaatttaatgatatctcattatctcattttaaagttgataattcaaggttctcaagtggtaaaacatgttatctagtgttatgaactagatacaaaaggcagctgtcgattaatgacaactgccgttaaaaccgtatttagattgaatccggctcgcgaatccaagccaacgccaaggcaccagcacccaagtgagtaccgataaccggtccaaagtacgtcaattcaattggcatatctgggtgacgttgttgcaagtcttcgcgccaggctgctcccgcttcttcagcgtttgcatgaatgaccatcgcacgcaaaggatactttgactctgcacgggcttgatcaaacagctcttctgcacgagccatcgccttcttcattgagcgcactttttcgaatggcacaatgtaatttgattcattgtcaaatgtcaaaataggcttaaccttcaacatcgttccgataatcgctgacgcatttgacaagcgaccaccacgaaccaagttttgcaaatcatccacaatgaagtattcgtccatcgtttgttgcaattcatccatcgtcgcaatgatgtcagcaggttcagcaccggcttgagccatttgtgcagccttcatgaccaagtggcccatcaaacgtacggtaatctttgaatcgtagccgtaaacagtaaagccgtccaccgcatcagccaggccagccacagtgttcaccgtacctgaaatcgttgatgccaagttaacaacgattgcaccgtcgtaaccatcagccttcaaagattcaaacaacgtaatccactccccaacagccggttgtgacgttgaagggaacgtttctgacgttgccaatttttcataaaattcagaagtggtcaaatcaaccccttcgcggtaaaccgtaccatcgataatcaccggaattggcattaccttaatgtctagcgcaaccacttcatctcggcttagataagccgttgaatccgttacaatcgcaatcttcatctcaaaatcctctcaaattaattgttagttgtaatgttctttggcaaacgcacaaaaataatcaagccaattacaaacagaattgatagtgcgccagcagcaaactgcacgcgtcccgtcacctgtgatacgattccaaaaatggctggtccaataatcgccgaaaactttccgaagatattaaagaacccgaaaaactcactactacgttccttgggaataatttgtcccaaatatgaacgtgacaaggcttgcatcccaccttgtgatgagccgacaccaaacgctagcaaccaaaattgattagggtgattaataaaaattgcaaataatgtaataccgatataaatcagcatccccataatcaagatattacgattaccaaagcgatcggctaaccagccgtacacaatcgaaaatggaaaggcaattagctgtactgccaataagacaacaatcagttgactacttggaataccaattgccaacgcaaatgaagacgccatcgtgaaaatggtgttcaccccgtcgatatagaagaaataagccaataggaatcctgacaaaacaggataatggcgcaaatcacgaatcgtttcagccaaacgacgtactgccgcgcggaccggatggtcatttgctggtaaagcatacacctggcgcacattcttaacgaatggcaaagtaaatgcaaaccaccaaacagctgacaacacaaacgcaaaaatgacaacaccgtgtgctgataggaaacttcgtccaatcataaaaataatgaatggtacaaggcctccaaggtacccaaacccatacccggccgaactaacccgatccattcggctcggtgtcgtaatgtccgtgatgtaactgtcgtaaaagacgttagcagatgagtacccaacaaatgataacacaaagactgctaacaataacaaaagattgtcagctggcacggttgctaaaccgagtgtgccgacaatccccaatgccgtaaaaatataaaacaagcggcccttcatgccttggaagtctgccaaagcacctaaaatcggtgccaaaactgctgccgcaagtgttgcaacagaatttgcatagccccaataggcagttgcgtgggtcgctgaaatgccaccattcgccgcaacggacgttaaccaaattggcaacaccgctgtgacaacaatgataccgtaccctgagttcgcccaatcgtaaaagatccagctccactcggttttattaaaaagcttcttcattcttactccttaaacgcctcgtcaatcacatgaccatcagttggtgtattaaattgtaagccaagcaacttagccatcgttggtccttctgacgtcaaatcaatatccaacgtcaattcttgaccggcctcaatatcaggtccgttcaaaataagggtcgttgtgtaatcttcgttgtctgggtggtaaccgtgagttcccttgtagcggtccacttcaccacgttccaacatctcgtttgtcacttcttcaactactgctggtcgacgagtttcatcagtgaagtagtagcccttttgagcttctaccatcaatgaagcttctggggcggcaccgaattcgaccaactcgctgtgatcataaacggccttaacaccttcaacttcactgaccatcttttgtacttgttgcaaaagactggcatctttcaagtaaacgtacgtcgcttcgtcagtgtgcttagcaagtacttgccagttacgagcgacacgaccgttgtgcgttgcacgaagccaaccacgatcagcaaacaacatgttcaagtgaatcatctttgacacgttcatttggtagtggtcacccaacaccataaagtccgtatcgtcgaaaatacccgcatcctttgttgcttgaatcaaatcaccaacgtgttgatccaaacgatccaaggcatcccaagcttgttgtgtgcgaacaccatagcggtgacggtgcgaatccatgtccaccaagtgaatcaacgtcaagtttggcttctttgtcttgatcgtatcaaccgcagctgccgtgatgaaattatccagttcaggttgttgaatacccttacgcaagtgaccaaacttacgatccatttgcaacaagaacaatggtgaactggcgcgtagtgacgttgtatattgatttgtccaaatacgatttgggaaaatctcagcaatattccaattaatcttagcgccggccgttactggccacaagaaagcagcggttgtcagtccagcctcacgcgccaagtcatacactgttggcaccttaatgtgctttgcgtaccagaaccaatcgggtgattcacgttctggttgcatcagcgtcgcattaaccacgccatgggtctttggataagtccctgtgatgattgacgtgtgtgaaggatatgtaattgagggataaacacccttaacttccttaacccacgtaccacctgcgattaaacttgcaatgtttggcaaaaattgcaatcgtgcggccaaatccgcgcttccaagtgcggccaaagaaattacaactgcatgcttcgccatgctcttcctcctacatttgcttactcaatgagttttccaaacgatttaacaaaatacgggccatgctcttctcttcagccgaccataatttaaaaatcgtttcctcataatgggtgtgttgttggttgacagccgtcaacacatcgctccccttaagtgttaattcataaatcaattgacgacgatcacggcctaccgcaatgtttgataccaattcttttttcaacaatgagctcaattgacgagacaacgttgaattatccaagccagtttcctctgaaagcttatcttgggtatcaaatccttctgagagatggtttaacaattgccattcagcaatggtcacaccttgctctttcgtgattctcgttaaaatggatttatattgtttttcggtatcgcgcaatgcttctaagacagttttcatgccggcctcctgatttaactaactaattatacgctttttgtattacacatgtgggacaaaaagcctgcacttacgtttacaaagtggctgtcgcaactaatgcaatgatttttgagccatgtaattcagaaacatgcagctcgtctgcaagccaacttgcattttcaaacgtcactccgccacccggcaaaatggtcaatcctgccggtgcttgggcaatggtatcctttaaatgactaaccgtttcagtaatcggttgggctaaatcaccaccgtgcgttaatactcgcactacaccgtagtttgccagccagcgtaaggcttgttgctggcattccggcttaatgtcgtcaaaagccatgtgatacacaacttgcatcggttgcgctgcctcgagtagctttaccatgcggtcacgggctaaacgcttttcttgatcaacaaccccaaatgtcaccattttcacacccaaagctcggaaatgaattaatgaatcgcgcattgcgttgatttcagcatctgagtaatcaaaatcaccaccacgtgggcgaaccatgacaaccaagtctacgttagcatcatgggccaacttcacggcagtcgcaaccgtattatcatctggtgtaatgccacctaagtctagtcgactatttagttcaacgcgatccacgccagcggcgattgctgcacgcattgtatccaaatcagctaaagcaatttctttaatcatgacgcaccctcctgtattctaatgcctattttactaaaaatgggacaacgattacagatttgcattcctggttaagagacccttaatgtttgctagacaataaaaggccggattacaacgaatccgacctctgatgatggactaatttaattttgtgcttgcgtcggcttgttttgacgtagcttttgaaccatcgcaaagtccggcgtcaccgccatcgttgtttgaccttcaaaaataacaaaacctggctttgagccattgggcttacgcaaacgacgaaccggtaagtaatcgaccggtacattagctgaatcacgggcctttgagaaataggcagctaacatcgcaccctcaagcaacgtttcctcagaaggttcagcgtcgtgaataatcacgtgggaaccaggaatatcctttgtgtgcaaccagatatcagactttgccgctgtcttcatagacaagcgttcgttttgcaagttgttcttaccaacttcaatcagcgtgccatccgtggcatagaacttctcaggttgactcacttgcggtttctgcttcttcttgctttgcacacgcatgtagccttcttgaatcaattcttggcgaatttcctcgatatcctttggtgatgcaatatcgatttgggccaacaagttctcaaagtaatccacttcttcttgcgccatcgcaatttgttcatttaggtacttaacagacgtcttcaacttgttgtagcgtgtaaagtacttttgcgcattctgagatggaccgatttggttagacaacgcaatcttcaaaggcttgttgtcgtcataatagtttggcaactcaattgacgtcataccacgctcaatttggtgcatgtatgtcgtcaacaactcacccttaatcttgaattcatcagcgttatcggctgcatccaattcggcttgttgcttcttaattttcgtcttgttcttcttcaactcattacgaacgacacgcaacacaaccgctgcttgttgttgcacacggtcacgctcagacttctcagcaaagtaaccgtccaacatttcactaagcgttggatattccacaatgttaccagctaacgtcatccaatcgaatggtgcgaaatcaacacccttctcagttgaaatcaaacgtggtgctggcttatcaaagtgagcaaaccaatcttgtgccaacttcatcgcatcgccatcttgttgcaatacagttgctaattccatcgctgaatcacgggcgaatccttggaaagtgtgttgaattcccttagctaaatcagacacatccgggttatccaaaatcaaatttgccaagccatccaacgtctcatatgggttcaccacatcttgcttaggtggcatgacatacgtaccacctggcatcaacgtacggacacggttttggtctgctgggacgtgcttaatcaaatccaaaatgcgttgcgttggatcatcaattaagaacaagtttgagtggcgacccatcatttcaagaatcaaagatgtcttctcttcatcacccaattcattgcgtcctgacgtcgtgaacttaatcatacggtcgttcgcaacttgttcaacgcgcaacaattgcgcaccttccaagtgcttgcgaagcatcatggcaaagttaggcgccgtttgtgggttagtgtacttaatacgtgaaatttgggcgcgcgcaaatgaagggtgcgcactcaaaaggactggataattcgtacgattattacgaatcaccaagaaaatttcatttggataaggttggtgaatcttcataatgcgaccaccagccaatgtttcattcaactctcgcaccattgcgtgcgtaaagagaccatcaaaagacatgatttgtcccctttcttttttcgattaacgttctgctaaaaagcgacgtgagacagattcatcatctgctaacttagcaattagaccagccatgccatcaaacttcatctcgccacgaatatagtggtgccaacgaactttaacatgttcaccatagatttcagttgcaaaatcaaacaagttaatttcaacggtcttaggacggttttcaccaaacgtaacattatagccaattgaagccatgccaccataccattgattgccaacttgtagttcaaccgtgtaaacccccacgcctggcaggcgctcaccgggcgttgtctcgatattggctgttggatagcccatttcgcgtccacgcgcttccccgtgaacaacaacacccgtcgtttcgtatggttgtgtcaaaagaacgttcaattcgtccacacgcccagtatcaactaattgacgtgcgcgggttgaagcaccttcttcgccatccacatcaacgcgggctacctcgatcacatcaaaacgtccttgcgcatacgctggcaagtgagccatatcagctgctgcgtcacgagcaccataagtgtggtcaaaacccgctaccactgcttgggcatgcaacccaaccatgtattgatcaacaaaatcttgtggggctaccttagctaacgccgatgtaaagttcacaacgtacgcgatatccaccccaagtgacgctaacaactcaagcttgcgtggcaaagttgttaaataagtgagtggggcatcatgtgtcttaaacacgattgacgcatgttgatcataagtcagcaccgccaacttcaccccacgacgttgtgcttcaacttgcgcgcgctcgataaccgcacggtggccagcatgaacgccatcaaaaaatcccattgccaacacaactggctcatcagcgatttttttattatcaaatgggtgatgtaatgtcataacttccatttcaactgccctcacatccaaaaatttcaatgcccttatcataccataaaaccccgcactaggcggggtttagtcaggattagtcttgatttaacgccatttataaatgaatgaacgtttatttattattctgtcaaactgtggcgcttaccagcttgaattgcttcgttttctgtcatttgcaccacattattcaggttcgtatttgatggcatgctcccagtaccgtaccagtaaaccttactcgtaccgcctcccgtcacataaaccatacggtcgccctgccctgcttcttgttgtggcgcaggttgtgtttcaggttgtgttgattcgacgactggtgcagctgcaaccggtgcggctgccttttcgactgtaccggttgccattcctgtcgcataatcaatcgttgcgtttggactgacattggcaagatacacgacagttgcaccaccattaccacttgtctcgtgttgtgagccgaaacgaatttcagtcgtttgaccgttttggtcataacccacatatgctaaacgcacctcacgtggcaacaattcgtcacctgaatacaacggtgttacttgataatccaaacggtaatttgggtgcaaggccaaccagttgtccagttgattctcatagtacaacatactatctgagttaccttgatccataccagaatagttgcctgaattcatccaggctgtctctggtaccaagttacggggttcatcgttcagccctgaaaattggtaaccaaccaagtgaccacgagccattaaccaagcactctttgcaccatccccataatacatcttgtaattgtgccaaccggctggattgtatgacaatcttggcgcacgcttcgctgttggctcttcatcgtttgacaattgaatgtgactatcaactgcacgacgcaaatgatcgagtggttgcatcaccatttggcgtgatgttgcatacgctaatggttgttgcaccgcacctgttaaaccatggtcatcagcctttgccaatcccttggtagcatcacttgcttcagatttactcgttgaactcgcaactgaagacgacttttcagtcgacgttgccgaagatgaagacttctttgacgaagaacttgacgatgacttctttacaactttatgcgacgttaccgatgaagagaatgtcgtatcagctgattcactatctgaaccaccgctaaacgcactgatgcccatcagtgccaagataacaattccagctacctttaatttcttacccatatacctatactccttatgcatttttgcataagctaagtatacagaaaaacgcccactaaatgcggacgttcataaaatggtcacattattgtcttacttacgttctgaagcaagggctgcctgtagaatagcttcacccttcataatgccgtaatccatcatattgatatctaccactgggtaatcagccccgtactcttcctcataacgagcgtgcatgtacttcacttgtggtgcaatcataatcacgattggttgatccttggcaatttggtcacgagcaaccatgtcagcaacaccaactgttgagacatccaagccatccttttcagctgcatcgttcatcttgttagccaacattgaaatcgacatacccgctgcgtcaaccaatacaatatgcttcgtcataatcattaccccaaattcttatcttctctatattgcctaagcaccatataatgatagcgctttcattggttgaattgtaaatcacgcacaaataataagcaaacaaaaagaactaacctagcgcactaagttagttctttagacgtctttagtgatacaaatcaaaacgaccctttgataggacttccttcatcccaccagtttccatcaacgacttgttcatgataaccttcttcaacattgaagctggatatcccttgacctcgtgatcagtacctacgacaccaatggcgctggtattaccaattgagcaaaccgttcccaatgacttgtaactaaactccgtcaattcgtaatccgtaatgtctgcaatcacgttcttggcggcaatttcacccatcaccaaggccaattgggctgttgttggcaatagttgctcactctctggatcaatcgctgcggcgacgtcaccgaccaagtaaacatgactgtcttccggatcttgcaagtaacgattcactgaattacggtttcgctttcccgtgtaacccgaatcagccatcacgtgtgaaccacggacaccggtcgtccagataatcgtgccagcgaccacttcgcctggcacacccgtttgacgatctgagtatttcaatacgcccggttcaacagaatcaattcccttaccagactcaattactgccccgcgtccacgcaaaacgtcaatcccgtagttaactaacttttctgagaagacactcaacggacgttgggcaccgtcaaccgccataatttgaatttggtttggcgcagcacctgcaatttcagcatacttatctcgttgctcatacaatgctcccaacaattcaacacctgtaaagccagctccggctaccacaatgtgcaagtggcgtgggtcgttgtcttcgcggtaagcatgcatttcgtcttcaatatgttgataaatacgctgtgctgattcaactgaatccattgccaacgcgttttcttgcacgcctggaataccgaaatcttctgactcgaatcccagcccaacaatcaagtaatcatatgacaatgcatcatgattagccaattcaacccgacgtgcttgcttatcgattttcgtcaccgtatcttccacaaaatacgtcatcttatcatcaacaacatgatcaattggatacgtaatacggtcggcatccaatgcacctgctgcaacttcatgcaagtctgttgcttcttagtggtatggattgcgatcaactagcgtaatctccaaaaatgaggcgtcgccacgcttttgcaactgacgcaacgccatcaagccggcataaccagcccccaaaatgacaacttttgtcttttccatcatattatcccccaataatatcaattattcttacaagtagaatactggctaaatatgaatatttttaacatgagcccttatacaacgtaaaaaaacgagtcaaacgcaattacgtcgactcgttaaaagattattcaattgaaaatgttcggaatgggcggtattgccccttatcctcacgccactcaaagactgatttcacatcaccatcgtgggtaatcacaatcttctcatcaattggttcatgcacattctttggcaatccgataccattctttacctttgcccattgttcatcagtgattgccacatgtggataatgagcaaccgcgctacccaatggttgcaaccaagcatctacattaccactctcgtccatcatcgcttggatgtcggtcaaactgtgggcttgtgacaagtcatagccacccgccttttgacgtgttaattggctcataaccgctggaacgcccaatgtcttacccaaatcaacggccaacgtacggatataagttcccttagaaacttcagccacaaacgtaaacttttgcgtcccattctcggcatcgaatgtcgtatcagaagtacgttcaaaacgatagatagtcgcatgacgttctggtcgctcaactgtttcaccagcacgtgcatactcataaagacgcttaccattcaccttaactgcagaaaacattggtggaatttgaataatgtcacccgttagcttagccattgcatcagcaatttcttcatcggtgaacggacgcgtcaatggttgtgattcaaccacttcaccatccaagtcttccgtggttgtcgcaaagccgaaggtcacttcaccagtgtaaatcttacctgactcttgcagaaattcgattgttttcgttgccttacccaaagctactggcaaaacaccatcaacagagggatcaagcgtacctgcgtgcccaatcttcttcatgtgcaaaatcttgcggagcttaaacaccacatcgtgtgacgtcattccggtctctttgtaaactggcaaaataccatccatgattcagtcctcaattctcatttagtatatgtatgaaaatagcgacccatcacaggtcgccattttctaaatattagtcgttttggtgcaattgacgaatcaaatcatcaatcttgttaccatattggacagattcgtccttaacgaacttcaattctggcgtcttgtagatttgcaaacgtgaacccaattccttacgaatcaagccagttgcagcttccaaaccagcagctgccttttgattaacagatgccaactcagacaagacactgtagtaaatctttgcttgttgcaagtcaccggtaacttcaacaccagtaaccgtcacaccttcaacacgtgggtcgcggatgcgcttaagcaacaaatcgttcacttcacgttggatttcttgttcaagacgtccaacacggaaattttgttgtgccattcttagctctccatttcctgagggaattagcgaggaatctcaaccatttcgtaggcttcgatcacgtcaccaatcttctcgtcgttgtagttttcaatcgtcaaaccgaagtcgtaaccgttcttaacttccttaacgtcatccttaaagcgacgcaatgaagccaacttaccatcgtagataacgataccgtcacggatcaagcgaactgatgagttacgcgtaatctttcctgacgtgaccattccaccaacgatagtaccgatctttgaaaccttgaacaattcacgaacgtcagccgtaccaacgatttcttcgcggaattctggatccaattgacccttcattgcagcttcgatttcgtcgatagcgttatagataacgttgtgcaaacgaatatcaaccttatcagcatcagcttgttgcttagcttgtggtgtaggacgaacgttaaatccgatgatgatagcaccagatgcttcagccaacgttacgtcagattcgttaatcgcaccaacggccgtgtgcaagatatcaaccttaacaccgtcaacgtcaatcttacggaatgaaccagccaaggcttcaacagaaccttgcacgtcggccttgatgataacaggcactgacttcatttgcttttcagccatcttgttaaacaagtctgaaactgaaacaacgttgttacggttacgctcggcaatcaaagcacgctttgcacgctcttcaccagcagcacgagccgtcttttcgtcttcaaagacaacgaaacggtcaccagctgatggcacatcgttcaaaccagtaatttcaactggtgttgaaggaacagcttccttcacacgacgaccgcggtcgttcgtcatcgtacgcacacgtccgtaagtgttacccacaacaattgggtcaccgacgcgcatcgttccttgttgaaccaagaccgtggcaatcgttccacgacccttgtccaaacgagcttcgataactgaaccagcagcacgttggtcagggttagcttgcaagtccatcacatcagccgtcaacaagatcatctccaacaattcgtcgatgttttgtccaaacttagctgagatgttaacgaagatggtgtcaccaccgtactcttctggaatcaactcgtattgcatcaattggttgataacgttttctgggtttgcaccaggcttatcaatcttgttaaccgcaacgatgattggcgttccagcagccttggcgtggttaatagcttcaattgtttgtggcataacaccgtcatcggcagccacaaccaagatcgtgatatcagtgatatcagctccacgcgcacgcatagccgtaaaggccgcgtgtccaggcgtgtccaagaacgtaatcacacgaccttcatcagtcttaacttggtaagcaccgatgtgttgcgtgattccaccagcttcgccttccgtaacgtgtgagttacgcaagtagtcaagcaaggtcgtcttaccgtggtcaacgtgtcccatgatcgtaacgactggggcgcgtggcgccaagttttcagtgttctcttgctcttcttcgaagaacttgtcgatgtcggcgatgtcgacttcaaccttttgctcagcttcaataccgtagtcggcagccaagatttcgattgtgtcagcatccaatgattggttttggttaaccattacacccaacatgaacaacttcttgatgatttccgttgcatcacggtgaatcaacttagcaatatcttgtacgttcataccaactgagtaaaccaaagtctctggcaatggttggtccttacgtacagtaggtgctggacggttctcgttgttacggttacgtcctggccccttcttgcccttcttgttgttacggttgttaccgttccagttgttgtttgggcgaccgttgttgttaccaccgcggttgttgttgcggttgttattgttgttacggttaccaccttggttaccgttaccgttgttgtttgaacggttttggtttccttggttgttgttacggttttggttgttaccaccgttgttttgtgcagccttaggagcagcttgcgcgttttgcgcaggcttcttaggtgcctcagccttcttttcggcctttggcgctggcttagcagctggctttacagcgttcgtcaacgtcttcacagcgttatcgtcaatcgttgacatgtggttcttaacgtccataccagccttttcagctgctgacaccaagtcctttgatgaaacattcaattcctttgccaattcgtaaatgcgcttggtcatgtgtcatcctccctagttttctagatattcccgcatctttttagcaaatccgcgatctgcaacagcaagtactgttcgcgctaatccggttgcatcagctaattcttgacgtgtcaaagcggttgaaaatggcacgttatagctgtttgttttatctgtaaatttcttcatgctacttgcaccgccatcgtttgcaaagaaaaccaaactggctttcccgttacgaatagcaccaagtaccatgtcctcacccgtcactagcttaccagcacggcgcgccaggccaaggagatttaatagcttttgcttattttgcatcgccgaacaattccttacgtgctgcttggtgatcaacgtaggcaatcaactcatcataaaagctgtcatcaagcttcgtttcaaacacacggtcaaacgtgcgcttcttcttcgccatctcagcaacttctactgacaatgagatgtaggccccgcgaccattggcacggttggttggatcaagctcaacgttaccctcgggggtgcgtacgacgcgcacgagttccttctttggtaccatttcaccagtcacgatgtcttttcgcattggaatcttacgtggcttcatgagcacacctccttaggcttcgtcagtttcctcgaagtcgtccgcaacatcagcttcaacaactggtgcgttagcggcttcttcttcgcggttcgccatgtcagcaattactgcatcgcgttcgctttcaggcttgatgtcaatcttgaagcccgtcaaacgagcagccaaacgagcgttttgtccacgcttaccaatggccaatgacaattggtaatcaggaaccaacaccgtaacggcacggtcgttagttgggtcgaagataacttcaacaacttcagctgggttcaaagcattcttgatgaattgggctggatcttcagtccattcaacaatatccatgttctcacctgacaattcgttaacaacggcttgcacacgcgcaccgcgttgaccaaccatcgtaccaacggcatccaagttgctgttgtgtgagtaaaccgcaatctttgaacggtcaccagcttcacgggcgattgacttaatctcaaccgttccgtcgaagacttctggcacttcagcttcaaacaaacgctttaccaagtcagcgtgcgtacgtgacacaaagacttgaggtccacgttgttcgttttgaacttgtgaaaccaagaccttgatcttgtcacccatacggtacgtttcgtttggcatttggtcaccttgcttcatggcagcctcctggttacctggcaaaatgatgtacaagaagcgtgagtcttgacgctcaacttctcctgtgatgatttcgttctcgtaaccgatgaacttgtcatacacaacaccacgctcagcttcgcgaaccttttgcatgatgatttgcttagctgtttgtgcagccaaacgtccgaagtcagcaggtgtgacttcgaaacggatttcatcaccgatttcgtaagccttgttcaattccaaagcttcttccaacgtaatttgctcgtaaggctcgtcaatttcttcaacgacagtcttaactgagtaaaccttgatgttacccttcttttgatcgaattgaacttcaacgttttctgattcgtcatagttcttttcgtaggccttcttcaaagcctcttcaatcgcttctaccaagacttcagccttgatacccttttcttgctccaaagcgtcaagagcttgaactaattccttactcatttggattctccatataaattagaagttatttgcttgacgtgcttgtgcaattgcagcgcgtgggacttcgacttcagaatcatcatccatcgtaatcgtcaacgtctcatctgagactgccgtcaactcaccagcaaagtctttcttaccatcaatcttttggtacgtcgaaacgcgaaccatcttgttcattgcccattcgaaatcttcaggggtggtcaaaatgcgttcttgactgattgttaggttagcagacttgatatcggcgcgtggcaccgcaattgtcttgcgctttcccttaactgtgattgccaacgttaattcgtcgtcagtcaccgccgttaattcaccgtcaatttcgttttgtccgtccatcggttggtttaacttcacgtgaatatacttttcaagtgcccactcgaaatcttgtgggcgctttagttcacgctccgcaccaggtgatgagacatccattaggtatgcctctgggaatggatctggttcgatttggtccaaacgttcaccgatcaattcagtcaacatcaccaaatcatccatgttaattgcgccgtctagacggtcaaccaacacacgcaagaccatatctgaatcttgcttttcataaatcacgtcccataggtcaaacccgtggtctgccaactcaggcgtgaggacagcttgcactgtttctacaacgtttgccatgttttccctcccttcgttccgtaaatcatctatgtcagaggtaaaaccctaaaaaaatgagcggccaaggaaattcgttcctggccactcaactaagagcttattcattaacagtatttatactaacactattcttacaaaatggcaaccagcatcgtcttctatataaagagatgaacctattttacgggtttatggctgaaattgtttataatggtggcaacattaccgaatggagtcatcattatgcaaatagaaaaactagtactggccgcaattaatgtcgttcgccaggcgtttggtcatggaacttttgttgaccctaacacaatgaccacccgaacagaggccgataataatattcaccgttatctggcggatgcacctagcattaacgatgataccatcgcgattgatgtgtacgagacagctgagcaaccaatcattgtcttcacatacaaccacgatgatcaaatcattgctggtgaaacatggacctggattatgctagatgaagctgttgtatttgacggcaccgcatttcgtttgatgagcccagatacagttgaacgattgcatctacaacttaacaagcaactagcacactatgccaagtaaacaaaaacgggccgaatcatcgtgattcggtccgtttttatctatttaaaacttcgcatcaataatcttggcatgttgcaactcagcaaccgtgtgagaaccagtcaattgcatcacaatctttagttcttcggccaagtgctcataaactgactgcacgccagctgcaccaccttgattcaagccccaaagcattggacgtccaagtgcgactacatcggcacctagggcgatagccttggcaacgtcctccccacgacgaatgccagaatcaaatacgactggaacacggtggttaactgccttagcaacagccgccaatgtatcgattgaagccggtgcgccgttcaattcacgaccaccgtggtttgatacccagataccatcggcacccgccgcaatggcagctagggcatcatcaggatcttgaatgcccttcacgaacactggcaagccattagccatctgcttaaccttggtaatatcagacaaagcaagatcctgcttggcgcgggcataaatttcagaaattcccaatccttcaccagaaccggccgcatttgagaaggcagctagattttccattggcaatgggaaagcaaagttattgatgatatctgcctcacgatatccacccaacgtcgcatcagcagttaaaataatcgccttgtaaccattctgaacagcttcatccaacaaatattggttaaactcgtcatcgcgagacatatatagttggaaaaacttcggcgtgtcgggcgatgatgcagcgacatccgcaatacgtgagttaccgtacgttgacaagctgaaaattgtaccagcggcgccaacacccttgaccgttacgcgttccccattttcatgcatcaaaccgtgagcagcaattggcgctgcaatcacgggcattgatagcggaatatctaataatgttgttgataggtcaggcgcgctgatgttttgtagcatgcgcggaataagttgatagtggcggaaagccgtttcgttgtcgtgcaacacttgttcgtcagacgatcctccgtcgacatagccaaatgcacccgcctctgtgtcacgttgtactgctgatcgcaagcgtggcaaatcgatgatgttcaaagcctcttcttttgtactaccttgataagccatctgtgattaccttctttgattaaattgaataagtgcaaatgaaatttacactttcagtataccgccctgtctttcaactggttcaaaaaaggtgtaaccgattacattagtgttgcgtggccccatcaatctttggcgcaacatcttgctcgtgatgatagaacttgtaatacaacaaacccgcaataactggaatgactgcagccaacaaataaagctcgcggaagttcaatagcttttcgacatcccccaatacaaacggaccaaccccgattcccaaatcaagcccgataaagtacgttgacaatgacacgccaacgcgaagtgcgtttggtgccagcttcaaagccaccgcttgaccgtttgacataaaggttccatatcccaaaccgataaaggcacctgacagcaacaacataaagccggaatgcgtcaccccaagtaacactagtcccactgccaatgaagcataggctggatacatgacataatcctcaccacgtgtgtcaaagatgcgccccgccattggtcgcgtaaacgtaatgaccaaagcgtatacgacgaaaaagaatgagctgatacttaccaagtgaattgtcttggcatatgaagacaagaacgacaacactgatgagtatgagaagcccatcaagaagccaatgcctgcaatgaacaaagccttacgctcaatcaaattatcaaacgtcatatggcgtaattcagccttacgttcaggcgtcaaggccaaattgtggattggcaaaagcaacgttgcaatcgtcgtcaacaaaatcaaaactgatgacacgatcacaatgaaacggaaattcgtgaggttcaacaaaatcatccccacaaacggaccaatcgccgcagccaatgacgtactcaacccatagaagttgatacccaatccctttttatcttcaggaatgtaatccgtcacaatggcattcgtcgcggttgacgtcattccataggcgaacccattcaccaaacgcaccgcgaacatgaccccgatattcggaataatcaagtacgccagcgttgagaccaaatatatcaatgccccaaaacgtaatgattgcttgcgaccaataatgtcgagctgttgtccaataataagacgtgcaatcaatgtcccaataacataaatccctgaagccaatcccgcctgtgctaggttggcgtgcaaatttgtgtgcaccacgactgcaataatgaccatcaatagatagtaaacaagataaacaataaaattgatggctgtaatactaataaagccagcgttaaaaatgctggtaaccggttttcccgttgtcatgtaaacataactcgctttcgtaaagtctgtgtctcagtctaaccatcaaccctaacgaggacaaaaatgagattttcgaaaacggaaaaaccattttttgttgttgtggtcgccttttctatactaagaacagatattcacagggagacaaatactatgccacacacgaatgaacaaatcgcacacgattttgcaattgccattgctgcccagaactatacgaagagttctgtccgaaacattggttatgcactggatgattatgatcaaatttatcaccaagtgttagagcaacttgcacttacccaccacattgcggtataacctaaactaactgaacgagtaaaaggcagtgtcagcactgcctttttgtgtttgcggaggaacaaatttgtggactggctactacagaaaaaagaacgcgataaattaacgctcaaaaactacctgatgaggcaaccatttccgatggtccccatcaagcaagtcattaacgacctcggttggtcaaagtaccttgtcatgaactacgggcaagccctagctgatgatttggcgcaactagatcaacacgaattggtttcgtttgatggtgcgcgccaacacttcattgtgcgaccagggcacagtatgctgtttgacgagttgcgtctacagtacctgaaccgtgcgccgaaatatcatctactaatggccttgttatttggcacgtttgaaaccgttgctgactttgcggtgcaacatgatttttcaacaccatatgtccgcgagctattacaagaactgcaacaagatttgcaaccctatcatattcagattaacgattctttcatattaatcggcaatgaaaaagaggttcgttacttcttctttcgaatcttgtttgattactatacgctccaaagcaatcccctcccattggcagccattgaatgggcacaaacaacttgggcctacttaaaaacaaccagtcccaatccaatttcacccgccatcagcttgattgtggaattccagctgggcatttggtacgtccgaatgactcaccaacacatcattacgcccagcgattcggcgccagtgcttgatgagacaaccgatttacccgcaacaacgcgtttatttcttgaccgcatgcgtgaacacttaacgcagtcattaggtctgtctgacattgaagccgggtatgaagcacgttttgccttgagtgccctctacgcctttggtttcgcacgcaaagaacattttgaaacgtatatgccgattgaaacgcgcctcttgttcagtgttgtctcggatatcatcgcccgtgagctaccggctttcttcggaaacgcttatctgatgacgcataaattaatcgatgccattcagcatgatttatacacaaccaatttacgcttagtctacttccacagtgcacttcggccggagccaaacgtcgatgaagccatctcacaatttccagtgtatgcgcaactgacccagcatctcatccaagccatcgcgactgagacgaacattccacatgacaccttgcaaaatacgttgttcgaggattacttcaatacgttcatcacgcgattgccacaagaagaagttttgcccattatcacggttgacttggaattcgtcgataatgccgcacttgggcgtcgcttggctcagttaatgaacaacatgccggcattaaatattattttgagttttgatacaccggactctgctgacttggtcatttccaatacgcacttatctaacaaccaacgacacctctacctgaaggccagtccgacgttggctgaaattgaagaaattcgtcaggtgctccatcaaatcacggttcaaaaattcgaacgctttaccgggcaaacaattccagttcgctttagctaaaaaggcacgtcgcccaataatcgggtgacgtgccttttagcattaaatcaatgtaaacttttcaatcatcaactcagggtggatgatcttcatgtcagtcgtgccctctgtggcataaccggcttcttcaaacgtttcttgcagttggcgcttaaaggcaaaccatgagcgcatgtcagcgcgcaacaactcttcaattttttgcaacacttcacgtgggttatcaaccttggcgtcagcgcgaatttcttcgcgaatcttttcaatttgttcagcggagaagtactttggctcatcaagcaattcagccacagcttctgacaacaatgggttaaccagtacgttttcagcacgtgacatcatcttcttaacggctagctcaatcgccatctccgtcaaatacgtattcgtgatgtgcaacgcaaccttgaccaacggtgacttttcacgttccttacggcgcttctctagctcgtttcgcacgtcagctggagatggaatttcatagctcatcaatctattctccttagtttttattaccttaatcataacaaactaattatggtttgtttctgattgaattgtacccgttttgaggacaactattatctagacttgctcggcgcattttgctatagttacgttaatgcatggaataagccatgtaatacacgactctaaaagacgccggtagtcagaaatgattaccggcgtcttttgtcttcattttttagccatttggcatatatttatgtacactatccccagctaaaaagcgcataatgaatatgtaatcaaatataagggggaatcattttgaatacagtagaagcattacgtgcaattgtcggtaagtcacacgtgattacgtcacctgataagtcattgcgttatcgtaaaggttatcgctcaggtcgcggggatgcattggcagttgtcttacctggcacactaatggaactttgggaagttttgaaggtcttgcatgataacgacctgattatcatcatgcaagcatcgaatacgagtttaactgagggatcaattcctgcaccgggctacgatcgtcaggctgtcgtggtgaatggctcacgtatcaaggggatgcagctcattaatcacggcgaagaagctttggccttccccggtaccacgttgtacaagttggaaaacgccttgaaggctattggacgtgaaccgcactcagttatcggatcatcgaacttgggtgcctcagttattggtggtatcaataacaattcaggtggtgcgttaatccaacgcggtccagcttacacggaacaagccttgtatgcacaaattgacgaacatgatgaactgcgtttggttaaccacctcggcattgccttgggtgatacgcctgaggaaatcatcacaaatctagaaaaccgcaacttcaacattgataacgtgccacacagtcgtacgcgcgttggtcataatcgtgattacgaggcgcgtgtccgtgacatcgactcagatacaccaactcgttacaatgccgatccaaatgaattgtacgaagtttctggggcttccggtaagttggcggcctttgcggtgcgtctggacacctttcctaaggaaggcgcatcaaaggtcttctacattggcacgaataatccggatgtcttagaacgtttgcgtcgccacattttgtcagagttcactcacctacccgtttctggtgagtacatgcataaggatgcctatgagttggccaagaaatacggtaaggattccttgattgtcattgaaacgcttggtaccaacgttttgccttatctatttggcatgaaagcaacgactgagcgcatcttggatcacattccaacgttcaagccatacttccctgaccgtgttttgcagcacatgggccagctcttccctaatcaactgccaaagcgtatcgaagactacagcaagcgttacgaccactacttgcaattgaagatggaaggtgacggaatcgacgaagcacgcgcctttctaaaggaattctttgcgactgaagatggtgattatctagagctagatgacaaagaagctgagcgcattgcgacccaccgttatgtcacggctggcgttgccattcgttatgaagaagtcttccaagacgaccacattgaaatcttgccgctcgacattgcgttgccacgtaacgagttcaagtggttcgaggaattgccaaaagaaattgaagataaaattcaatacaagctctactatggtcacttcctcgaccacgtcatgcaccaagactacattttgaagccaggtgtcgatgcgcatgagttgaaaaaggaaatgttggccttgctagataagcgtggtgtcatctaccccgctgaacacaatgtcggtcacttgtacgaagcagcacctgccttggtcgcccactacaagaagaacgatccaacgaacagttttaacccgggtgttggtaaaaccaccatgcacaagtactggggaaattattaattagctaaagaggccaggaatttcatcctagcctcttttttttatgcaaaaaagcagcaccacgcgggcactgctcttatgctagatttacggacagatttttctctgccctgtaaactaatagtagaggagcattttttatatgattcgatattcaccagaatttaagcaatctcttgtcgagatgcacaaccaagggcgttcttacacggaactagccgctgaatacgggccttcggccgattcaatccgtaactgggtcaaattgccgaagcttttggtaaaacagctaagcttgctacgcatactgcacctgaagcgactagcgcaccaacaattgcggccataatcgctgttattgcaatcgttttggtttgggccttccgcaataagcgtaacaaggagaactaaacatggacattttgaagaataagtttgtttgggtcggtgtagcagttgttgtcatcggtggtgcatttgctatccactcacacaatcaccgccaagttgatttatcgaaccaaattaaggtgacttacaatggatacgacacagacggtgttatttcgccagataatactaaatttgagaaggagctatataagttatacgcaaagcgttcagggctaagccagtaccaagtgcaacaactacgtagcacttcttctcgaaacagtgtcattagtagtctgccatctgatcagcaggataaggcaactgaagtcgctaagcggttagatgaagttaagttcaagtatagtaacgaaacgaacttgaagaatggacaatcagtcaagttaaccattgataatggtaacgacaagactaaccccgttaagttctctgttcgaacgtttaaggtatccggcctacgcaaaactaagacaatttcaacaagtaagtacttgaaaactatcaagactagcttcagtggaattaatggacatggacgtgttctactgaaaagttcaaactcaatgttcagctcagcttacgtaaaaaataatggtaagttatcaaatggcgacactgtcacaattagtttaatgagcagctttgaaaatggacaaggaacgaattatgttggttcaagagaaattaaagctaaggtatctggattagttgatccatcgcaaatttctaatgtgagcgaaattgcatccgcctttcaacccgacgctgaaaaagcagcctcagcagatgcatacgaaaacgttacgccactaggcatctatttaattgaacacgatagcaactcttcatcaggcatatccgagggaaaagcctactttgatgatgatggatctaatgttacttatgaagttagagctctgtacaaggcgaactcagaagtttcaaagtcttttactagggtttatcgcgtatacatggaaaacttgaccctatcaggtaacgagttacattccgatggcggattccaaagtaaagaagcagatattcgccgatatgtcacttattcagatgatatgaataaggaactaagcactgttaaatcatataatgccattaaattacagtaactaagtttataaaaagcaataacccgtaacatcacaagaccgaataacggcggtgatgttacgggtattttaatgtttaattagcaactccaaacaaaatgaaaaacctagaattatgtgcgaatacaaaataaaagcaccgaaagaatttttctctcggtgcgttctttgatgggcctagcaggactcgaacctgcaatacccggttcgtagccggggtgtttatccaattagcatataagcccaatatttaattcgttgcctcaacaacataattaaatatacgccctttgtttttgtttgtaaagtctaaaacctcaaaaaagtaattatttttttgcagcccgttatcctagacatatttgctaccttcacgaattgataatggcgtcatttcgctttcatgggttgcaataaactcacgcacccaatcaggatttgttttactatactgacgtaatgcccagccaatggctttgttaatgaaaaactcggacgaaccaaagttagcagttagaatttccgtcattaacgctgtatccgtttgatccttcaaaaccaattgatgaagaatcgccaaacgacgcacccaaaagtcatcatgtcaactccaagccaacatcgctgcttttgttctaggatacgtgacaacaatatgtccaacttcgtgcgccatgttatcaactgtatcccaccatgacttacgcatcgccaatgcttggaaacgcactaaatcatcaggacccaacaaatccatctgtgctttcaacatatccaaggccacatattggtattcacgggcatcttgttcccaagcagcctctacaaaatcccagtcaatcacgccactttgcttggcagccttgataaacggcttggttaactctcggcggactggtgttttaatgcccagaaacggaaactggttgcgttgatacgtagccatccccactgccgtttccggatctgcatgcgccttaagtagatcaaatacttcttgcatagcgcacctccctcgtattattaagcacaagtatagcaaattaaaacacccaacctcgtatccaaacaaagttaggtgttaaaagtcatattttaaattaagcaactgcattttcaataacagccaaaacgttcgcacggtagtctgatgactcatcattcaaacggcacatttcgtagtaggcatccttgtagtcaaaaccatcacgacgcgttgcagcgtaaaccatcaacaagttgcaagcatcttcagctgattcaagatcacgtagcgtctcaccggcttcgatagtacggatatctgacatgtagtcttcgtaatcaaacgtataccatgtttgcatttgctccaaaactggggcagcccaaccttcttcacgaacaacagatgaaactgtttggcccgcacgcaacttacgtagcacattgttaaagtggttgtttacattaataatattcgtcgtcatcacagcagtcatgtcgtttacctctaaatcatttttatcaatgcatttactatagcacgaacttgtgaaaaaaagaacaaagaaacacccgaaacgcccgtgaatacgcttacatagccgttttattttgtgaaaacgttatcattgttgcgactttgcgagcttttcagcaacgcggtgattgattttagctttcacatcgtccgtccaacgtgataaagtagtgaacacaaaaaacgtgcctagctcaaaagctaaacacgttaatcaagattacttattctcttcttgcaattccagcaaacgagcacgcaaagcatcatcgtatgccgtcaagtacaaaccatacttaccacgcttgatcaagacgttcaaaacgttggcaataaaggccttatattcttcttccgtgaacttacggtcttgacgcttcttgaaaatttccttgtgagagtacttttcaggaataatcgtcacgctatccgtcttaggatcgtaaccaaatgaaggaccgataatcatccctacataattcaaatcaaatccttgcaacgtataaatcgttccgacttgcgtaattgaaccctcacgcttagcccagtgcgtacgttgtggatcccactcgtcccaaggcaagttaaacgtatccatttcaacgttgtggcgtccatcaatacgtgggaatcctgacgttgcaacaacacgactttgaccgaattctttgttcttcgccttaatggcttcgtacaaatcacccgccttgtcaaagaccttgaattcaaaatcagaattgtttgggaatgggtgcaatggcttttcagatgtcaaatcatccatccaatccacttgttcttggctggccaccatacggtattggaagtccatgtcgaattggtggtatgggtgcttgccaatcgtcttaaatagcaagtccttgtcccagtacatctttgattggaacacttgggcgaagtcgtaaaccacgaccacaaccttagccaaatccatcaagtcctgcaattggttttcaccattgtagtgcatgtatggctctggctttgacaatagcaagtgcgcttcgtcaacgaaaataacatcgtacttccagttacgcttttgcgcgttgttaatcaatggcgtaggacgcgtaatatccttgtcgcgcatacctggaatatcaacggccaaatccttgtaggccttgaatagctcagggtggttaacaaccaacgcagtcttgtaacgcttatcagtcatatacttggtaaccaagttcatcaaaacaactgacttaccggtaccagcagcaccttggataattgccacacggtgatcgttttgcttcaaaccatccccaatgtaggcgttcatgttagaaatagcggcttcttgttgcgctgatagattatcaacgaaaaattgttcttgtaaaatcttattcataatgctttcaattatacaacgtgcaagcctattaagccacggaccttcctgacaaaaaatacatgtacatttgtgccatttctagcactttgcccgtgtcatgactgacaggctgcccaacgtcgtgtatcttaacagcaataaatcagttcaggaggaaccaatcatggtatccattcaaacaattttgacatacggggtcatcactctagccataattcttgtgatttcaggtatcgttggcatcgtcaactacatccgtaaaaacgctgggcatgtcacatttggtggcgtgattaaaagtttcttcaaaggaatcggctggccattcatttggatgattgaattcgtcggcttggcaattacattcttataaggcattctctagcttcacagtcatgtgaggctttttattgcataaagccttgcaccttcgtctgattgcggtatactatccttgaactggtaagtaatcacttacttaccaaatttacacaaaggataatatgactatggctcaagaaattatcaacctatctgacgtcaaaaaatcgtttggttcgcagcccgttttaaaggacgtgtcttttcaagttcacggcagcgaaattgttggcctaatcgggccatcaggcgctggtaaatcaacaatcattaagattacgcttggtatggaaaaagctgatggcggccaagcaaacgttttcgacacagtgatgcccaatcgtgaattactagctaatatcggttacatggcccagactgacgctctttatgacgctttaagtggtcgtgaaaatctcactttctttgccaaaatgaaaaatgtcaccagcgatgtcgtaacagaaatcaatcacgttgccgaagtggttgatttgaccaatgacttagacaaacgcgtcagtggttactctggtggcatgaagcgtcgcctatcgttggccatcgccctgcttggtgcacctgaactactagttctggatgagccaactgttgggattgatccatcattgcgccaaaaaatttgggctgaattaacacgcctacgtgatgaaggtcgcgccattttggtaaccactcacgtcatggatgaagcggaactaaccgatcgcgttgccctactacttgacgggtctgtaattgcaaatgatgcacccaaggcattagaacaacaatacggtgtcgattcaattgaacatgtctttttgaaagcagaggcccaacgatgaaaacatttgcaatcgctaaacgcgttttaactgaattgattcgcaacaagcgcaccctcgccttgttgtttgtggcgcctctactagtgctcgcactcatgagctacgtctttaacgttaataccacgacaacaagttcaatcgcgacagtccaagtgcccaccgcaatttacaacaaccttgatgctacaaaacacgtttctgttaaggcttatgattctacggcatcatctaagaaggctttggaagctgaacgcgttgatgcaatcattgattattcagataacacctaccatgtgacttatgccaacacggatgtttccaaaaccgcattagcgaagatggccttacaaggcgccatcaccaaatcaaacattaccggcatggcggatgcgctaaaagctttagaagctaacttgccggccgctgttcagacaaaaaaagtcgctgcgcaaacaccaaaaatcctgaacacctacaattacggcaatgccaactcaactttctttgataagatgatgccgattttgatggggttcttcgtgttcttctttgtctttttgatttcggggatggccttattgaaggaacgtacatcaggtacacttgaacgtttgctagcaaccccagtgcgtcgtgctgagattgtctaaggtacttaattagttatggttttgtcgccgttgttcagacattgttaatcgtcttgttcaccatcaacgtccttaacgttcaagtcgctggttcgattttcttagttatcttaacgacccttttgttggcattagttgccttagcgttggggattttcatgtcaacatttgcgcaatccgaattccaaatgatgcaatttatcccactggttgtcgtgccacaaattttcttttcgggcttgattgatttgcatgctatggctgactgggcacaatggttagctaacttgttgccaatgaagtacgccgcgtccgctttgaccgatgtcatcctcaaaggggctaacttctctgacattgccggtaatttgcttgctttggtaatttttattatcattttaacgattggcaatattgttggcctaaagcgttatcgaaaggtgtaaattaacatgactaatcaagttttaagttttgatgaatggctaacaactactgatatgcccgatggcaagcgccgtattctacgtgctgcagtaagcctatttgcacaaaacggcttccatgcaacctctacggcagccattgctcaagaagctggtctcagtgatgcgaccatgttcaagcactttaaaaataaaaacgcgttgctggatgcgatcctggcaccactccttgaacaactagtgcccaatgtcagtgagcaattcgtcacatctgttcaagataaagcaaccaccattgatgatgttatcgcattcatcgtgtctgatcgttggtcattcatgcaacagaacaaccaagtgattcaggtattagtaaacgaggccttagctaatacgactcttagagaacatatgattagcgaaatcggcccaaagttaggtcatgtgacgacaattttgcaggtcctaatgcgtagtgattcatccattaatcatcagttaaccggctatgatttgcttcgcattattgcaggtcagctgatgattcatttcatgtcacaatataagttccagactcaacttaataatgaaacggtactcgcgaacgtcaccttaatgacccagcaagcactgcgttaacagaaaaaactggtaaattcgccacaaatgggtgaatttaccagtttttcgttttcattaccactaggtccagacataatcattctgtacggtctcaattaccttccacaaatagtggttaccaaaataccaggcctcgatgtacgcagcgagtgttatcaatacaatccagactgtatccttaccaccattccgtgcacgctttctaaaatatctagcattaacccagatagtcacaagtaatggcccgaacaccaatgcaactagtaacaaaactagcaatagcagtatcaacatccatatgaagtcattaccacctttgacatcccatatcggattaatcaaatgccaccaaccatagaaaacaaataacatgtaggcgggcataaagaacgctgtcacaacgtctagtatgataagttgtactgttttactcttcatccggttatgctcacaattccttggccatcaagatatctgtttgtcgatccgtgcccatgtagaaatcatgggattcaccagtctttaagaagcccatcttctcgtagaaagcaatcgcatttgggttgtactcccaaacaccaagccaaatgcgatccttattcaactcatgggcaaccttttcagcctcagtaatgaagacgcgtcccaatccacggcgttggaaactcttacggacatagatgcgttcaacttcgagggctgattcacccatatcttcagactgggcatccccaacattcaacttcaaatagcccgcaatttcatcatctaccatcacaaaataaaataatgactcggcattttctaattcttttacaagcaccgattcttgatatgcatcagccaaataatcacgtaaattttcaggtgtgttttgagcaccgaaagtatctgtaaacgtctcgattgaaatctcacgcagctcattcacatcagttacgcttagtcgcttaagtgtcgttgtcatatttctctcctaatactctcgttgatggcctttcttcacggcattccagtcagttgcaacattctcacgcattcggtgcaacaagctattcagtgtttgcacttcatccgctgtgaatccttgcaacgctatcgtctctgaatgatcattttcacgtttgataacgtcatacagttcacgacctttatccgtcacttccaaatgcttaattttcaagttttctgcgttatcacgcttcacaatcaaaccgtccgctaatagcttcttaacggcacgcgcaacggttgtacgatcaaccataatcatctcagaaagttcttcctggatgataccgggattctccgcaatgcgggctaaatacaagtactgccccttcgttaggttaaatgacttgaattcaacattactaattgaatccaaagctcgggcaatcatgccaatttctctcaaattactcgtcatattgttatcctcatgaactatcatatcttgtttttgttgtatatgcaacaaaacgtccgttaatgacaacgaacgtcagagtgttataagttcaaaatatgtggaattgtgccggtttcaacaatgaccaacacacctagtacgatgtaaacaaacgccgtaatccatcgaccaaaacgttcaaacacttccccaattttcggaatcttcgccaaacactgactgataaaagccagcagtaagatattaatcataaacgttaccaacgccacggctaaccgaccagctgataaggttgccatataaggcgtaaataatccgatattatctggtaagcagctagacaacgcaattatcatcatcgttaagacgagtgatttatcttcgcgttctcgcgcaatcttgagtgcattttcatctgcctcacatgccgcaaataagtaacgaataccgaacgcaattggcacaactcccaaaaatccaagcacccaatccgccggtataaatttaaaaacaaacgcaaacagcatcggcaccgttaccaaaattgttgatcctattacctgtccaatcaaaatctgacagtgttctgttttcctaggatacatggcaaataacgtcaacaaaattaatagcaagtcgatcgcagtcgtccaataaagaatcgtcgtagacacgattgtgctaaccatctgttcatccccttcctaaacatgaaaatattaacatgtttaatggaggcgatttctcatcactcacctatccggtatacctttcaggtacgtggcaaaaattttcttgtgtacaaaaaaacgcctacgcaagcgtatagacgttaatcgttaattacaaggcatcatatagttcgtcagaaacgggctcaagccactctggcgtaccagcggtaatcgcgatgtgctcaaaccaactgtccttcttggccccgtgccagtgcttcacgccatctttggtcacaatcgtatcaccagctttcaatgattgcgctggttgcccttcttcttggtaccaaccttcaccagctgtgacaagtaaaatttgataaccatcatggtgaatgtgccagttattacgtgaacccggctcaaatgatactgatccaaccccgattttgtcatcaggtgacgtcaccaaattcgttagatacgtatcgccaacgaagaattcaccgtatggattcaaaacaccagccgggaaaatcgttccttgcttaatctcttcgtactttgccattacttttctccgaatacttcttttgcaatgttaaatgctgaccacgcctttggccaaccaacgtagaaggccaattgcgtaataatttcggccacttcatcagcagtcaagccgttatccttggcctttgccatgtgaaatggtaattgctcaaaagccccagttgaaatcaatgccgtaatggtcgttaatgaacgatcacgggcggacaattcagcttcacgtgaccagacttgaccaaacaatacatcgtcattaagctccgcaaactttggtgcaaattcaccaagtgcgtcatgtcctgccgttactttttccgtcatgataatcacccctagtccaaagtgccaccgtaaactgggaacccactaaattcaccataatcattaaacgttactttgtttaacatggccatatcgtcatcagaaatcgtgaagtccactgttgcattagccgtcatgtgtgcttcagacgttgcttttggcaatggcaatgtgttcagttgcaataagtagcgaatacccaattgcgcaacggaaacgcagtacttattcgccatttgttgcaagtttttgtttttcaacatttcaccgtgaccaaatggtgagtaggcttcaatttgaatgtcattcttttgggcgtactcaaacacgctaaatggtacgttaccaatgtgcgccaaaacttgatcaaccgccggcttcacatcactgttatccagaatattctgcaagtcgatttcatcgaagttcgacacaccgatagcacgaatcttaccagcagcttgagcttcagatagcgcacgccaggctgccaaactcccttcaaagaaacgctcatcattttggaattcaacccaaggttttggtgagtgaataatcatcatgtcgatgtaatcgagattcaaatcgtttagtgaacgatcaattgcagcgactgcctcttcgtagctcttaaattcagcttgcaactttgtcgtgacaaatatgtcttcacgtggcacaccggcgttgcgaacaccacgacctacaccaatttcattgccgtacgcttcggcagtatcgatgtgacggtaaccaactttaatggctgtctcgactgccttggcggcatcatcattatcttcaatcatccaagtcccgaacccaatcttcggaatcttaacgccattgttcaaagtataggtttcatcaaaaatcgtcatactaatgtcctccgtttatttaagaatcacacgcaccgttgcatttcgtggcccgtcagcaatcatcggtggcatgtattggctacccgcgtatttcgtccggtaggcgtcatcaatttgatcttgcaatgcttcatgatcagcgactggcacaagttcgaatgcaaccgtgtattcgtccccggcaatcataattttgccggcaccttggtctttggcagcattgtaccaacgtgagcgttgaccgttccaagcacgtacatagagttcgccgttgaccacaacagaccaaatccacgttaacgtgccaggcgttttaccgtcggcacgataaggtgcgatatgaaaatcatccgcctgcgcaaacgtttcttgttgtgttgctgttaatgtcatcatttccacctccactactttatgccttcagtatattgcgctataatcaccattaccaatgctttctttttatggctaactataacgaaaggtaatgatatggaactacgtgttttacgatattttctagaggttgcccacactggtacacttaccgcggcagccaccaaactcaacgtgacgcaacccgctttatcacgccagctaaagttgctggaaactgaattaggtgtcacactcatcaaccgtgatcataaacccgtttccttaacccctgagggcatctatttggcaaagcaagccgaggacttaattgctatcgctgataagacagtcaccaatctacagtcaaaagacgcgattgccggtgtcatcacgattggcgcggcagaaactaagatgttcaaccacgcaattaaggcgatttccgccagcaacaagcttatccgaatgtgactttcacggtcatttccggatccacaaccgacttactagatcggcttaaccaaggtgaactagatttccttttcgcgctcgatttcacccaaaaggcctcgtacgactatctcgattttccagacgaagatgtccgtggcgtattcattaataaacagcatcccctggctaataaatcagcaattactgccgatcagctcaaggaatacccgctggcaatttcacgtcaatcctctttcaacgattcgctagtggaagaactcggcctcaatgcatcagatttgaacattcgcctcaagtacaacttaatcggcaatgccgggatgtatccaatgattgataatcaaattatgctcgtaggtatcgagggggttatcaacattcctgaactacgcttcaaaccattttcaccaaaaaacgtttcagttggctcaatgatttggaatcacacccccttcttgtcgccgcttcacgaagaatttattcgttttctagaagatgaattgacgaacacacctcgtgatatgtcataatagcgagtacaagggggaattaaacatgagcattacagtaaacttgtactacactggtgaaaatggtgcagctcaagcattcgctaaagaaatgaccgactccggcgttgtcaatcgcattcgagccaccccaggcaacgagcgttatgaatattttcaaccgcttgatgacccagaaacaatcttgttaattgatgcatggcacaatcaggcagctattgatacgcaccacgcgtcaccaatgatggctgaaattgcgcaattacgagagaaatacgatttgcacatgcgtgtggaacgcttcattagcgataaggacggcgtgccggcatctgaccaatcatttattcgtaagtaacaaagcgagctctagtagctcgctttttatatttgaaaagaaactctccagagcagtacgtcatctgccaaatacaggaaagaccgggcctcaaactgttttgtaaaactcggcgtcgtatactgcaggtggaggtcagtatcatgcaacatgcaacgtaattcgacgctacttatgatgaaacatatgacacgatgcccaacggcaacatccaatttgaattgaccggtatttggcgtccggtgtgttatgacaaacagtcaaacatcctgacgttctgctctgttacacatcccaaaaaatattcaaaaccaatgacacttttcggaatcaaaaaacttgaacttcagacggctgctgttcgcactgaacaaatcacccaattcaaagatcaaacagaacaagtttttggtgagcacggacagcttgtgcatatttttatgcaaaaaacacacggcctaactcctgagcaatttcgtgaacagttttctaagatgccaaccagcattggccctggtgatattgattgggtcgcgttgttagatgagaatcacgcctcgctaaacaaactcaccttcatcgaagagttttggtaccgtctctttctggggattgcttgtgtgtatcataaccacaattggattaactacgataaattcaactatgatgaagcctatcgttatcgtgtgtacctggttgtcaaagaaatggtctgctcgacatattttgaatattcggaacctgatccattcacgctaaaactactcatgtttagtggcttggccattacgctgaccctgactttggcacacctgattcattttgagccagttggggatgtctcaaattggacgttttatctggccggttttatcatcggaatatccttaatcatttttgcgacaacattatggattagcggtcgtattcgatcgtcctcgactatgcgcttagaccatcaactatatgcatggctgggtgtaccaccatcaaacatcaccattccactccaccgcgccagcaagaaaaaactggtggtgactaatattacggcgtaaaaaaaagagcgactaaatcgctcttttttcgtctacttcaataattcagcttctaacgcttggacagccgcttggacagcatcccaaggtgcgccaacaactggtgaatacgtcaaatctaagtcgctaaacgcttcaaccgtcatgccgttataaattgcggttgcaaagacatctgcgcgtttcgccacttcgctaccatacttacccaccaattgggcgcctaaaatcttgtgtgactctttgtctgcagtcacacgaatcgtcattttttcagcacctgggaaataacccttgtgatcatctacgaccgcagttgtcgtgattgccgtaaagccagctgcagttgcttcgtttggcaacaagccagttcgagcgacaatcacgtcaaacgcacgcaaaacctgcgagccaatgattcctgcaaagtgtgactcacgacccacaatattagcaccggcgacgcgaccttgtttatgcgccgtcgtacccagcggcaaatatgtcgcacctaatagtcggtgcttcgtttgaaccaaatcacctgctgcgtacacatcgggcagattcgtacgcatttggtcatcaaccactaccgcgttttgatcagtaacggtcgcaccagcattaaccaacaactcactgtttggtcgtacacccacaacaaccaagacaaaatcgaatgcgtcatccgtcgttgacccgattaggtggtacccggcttccgttgcttgaatttcagtaatcgtttcatcagttaacaccgtgacaccattatcggtcaatgtatcatgcacaaaagcacccaaatcgggttcaaccgtcgataacacctcagccccacgttgtaccagcgtcaccgaaacatcacgtcgtgtcaacgcctctgccatttcgatacccacgtaacccgcaccaacaattgctgcgcgcttaggttgatgttgcaccaattgtgcttcaatatcaaagaaatcgcccattgtatgcaatacatgaataccggcgccttcaccgacaatcggcaattccttagggactgcaccagtaccaaccatcagcttgtcataagtaaacgtcaattggtcgtcaccgcgcatcgcagtcacggtgtggttcgccacatcaatggccgttgcccacgtgttcatgtaaaaatcgatgtcatacgccttcaaatcatcaaccgttctatgcgctaaattctgccactgggtcacttctttactgaccgcatatggaatcccacaaatcgacaagtttgggaattcatctgccaaaatcattgtaattttaatcgtgccattcagttcacgggcgcgtagtgcagctgaaataccagcatcacttccaccaatgatcaatatctctgtctgtacgttggtcatttagtcgtcctcttattttctaatagtaagttaattatatgtaggagaatccaaacgtgtcaaacacaaaaagccagcagatgattaatcacctactggccgaatgttatttctagactaattgaattaatgcaacaccgacaaccataataatgatgccgagaatttgcatgacattaacgcgctttttaactgattgataccagccaaattgttgcacgatgatggttccgattaacatacccatcaaaccaaggatggcacccatacccggtccaagcactggcacaacgattccaatgaagaacacgaatagtgatccaggaataccgcccaggaaggcccaccatggtgctgccttcataccttctcgattaaagaatggtcgttcttttatggcaactaaaattgttagcaaaatcaacgcaccaacgaacgacacaaaggcaccatcaactggtgcacccaacaagtgacccaaatgtccggtaatggcttgctggaatgacgcgaacattcccgtcaaaattccccaaacgtgccagaaaattgacccggttggcgctgatccgttcttgttttccaaacgcgcgctcaatacaaccgcaaccaatacaccaatcatccccaagatgacgccaatgaccttcacggctgtcaacgcaaccgtttctgcgccgacccaaccaagggtttgaatcatcattgacatcacaacttgtcctaatgttggtaggacaaccgtcttaaccgcaccaacattcttgaataacaaaatgttcgatgtttggtaaagcatcgagaagattcccgctgagtagacccaccatggttgttttgtcttagttagcgcaataatttcgcccaagaaatgtgggttttgaataaatgcaatggctcctaagaaaatcacacccagtgaaaaactcaagaatgcagcgcggaatggtgacttcaaagcaccacccaaacgcgcgttaattgggctttggttcgaaaccgcaaagccacctaataatcccaaaatgtaaaacataataactccattcgtacagactcaaaattcagtaatcgctttatgaattttaacgagtgctgacgatgtttacttgataaagtccacagcatcaacactatgctgtgcacccacctggctgttcagaacgcatgttagaaccctccacttatttttagcaagtaacatcatgcacgcattttcaagatttgaaaaggttatatcacttttagtcttgcggcaccaaacgtccattaacaatctgccaaacatcagtcgccacatcagccacaaactgttcatcgtgcaaaacgaacagtacagcttgtttggtctcttgcagatacgccgttaaggcttctaaggctggaatgtccaaataattggttggttcatctaacaccaacagctcactcgtctgtagcaatgcttttaccaaagccacacggacgctctcaccgccgctcatttgaccaaccatttcattgacctgcatcaagcgaatccccattgcgcctaagaaattacgggctacctgttcagactcagtgctggtcatcataacattttccagtgccgttttcgtcgtatctagctggcttaaatcttggttagccacgcttactcgcagattgtcagcatgagttacgccgggtgcacctaacaacaagtgctgaatgagcgttgatttaccagacccattcggaccaacaattgccacacggtgcccggtttcaattttgaatgacacgttctcaatcaaaagattatctgcttgcgaaaccgtcaaattcaaggcggttacaactggtttacctggtcgaacattcagtggattttgtaactttagtttagtggcatcaactggcttctcaaccttgccaagacgttcaatgcgactattcaacgctttcttttgttgtgaaaaccctttttctaccccatttaacccagatttcatcgcctcaatttcagcgtgactgtgcttgtgggggttaattttctttgctcgagccgacttttcacccgctgtttgcgctcgctgagctaatcgtttcttttcgtttgtgacttgcttatagtcttgcatctgagcacttcgttttgaggcagtggcagctaagtaatcatcataaccaccattaaacgcggtaacggtgccattttcaaacgaccaaacggcagtcgccatctcacgcaaaaaggcacgattgtgagataccacaatgaccagtcccttaaaccgatgaatcgtcttcaccaaccacttgtgatgatcaacatccaagtgcgatgttggttcatctaaaatcaaaatgtcaggtcgctctgaaatggcttggcgaatcaaacgttgcgtcatttcaccaccagattcacccacgatgtcattaatttgtgccactgtcgccacatatcccggtaaattaatccgaccagtataatccgtatcaataccctgcaacatgtttagtaacgtggtcttaccagcaccgttttcaccaaccatcgcaacaacgcctgcggtcggaattgttagattatcaatctcaaacagcgtttcaccatcaatagtctttacaacgttttgaatttgtccgtgttgcataaaagcctccaatctcaccacaatgagactggaggcactctaaaaagcatgttcattaaacacgcagaagtccacactaaaaccaatctcattgataactttctatcattatgaaatcagcttaattgcgcaatggaccttaccccgtgttcttttagtaagtgtagtatgacagaagcgttagtcttggtcaagtttgacaacttaacgctgactaatctgacgtgaaagatgcacaccatgtttagcgatataaaatgcccaactgaagctatgacgaacccgccaaaaagtcttataaggctgttcaacgtcttcaaaccgcacaagctgccaaccgccctttttgctccaccctgcaaacacatctgaaaattcaatcatcaattgataccggttaacatgatcaaattcattagagactagttgattgtcttcgtatgtcatccagtagctatttaattcttgtaatgccgtttttgctttataaaataaccagcaccagcttgcgattgatacgggtaacagccacaacatcagcgttccaaacatattaaagacataaataaagctcgttaaatttcgatgcgtatccaacatagtcagaaatgctaatagtaccttcaatataaccacagcaccaaccactcttgccgatcgacgccaaacggaacctatccaaaaacgctttgcagttgtgacttcgtttaacttattgatcaattgctgaaattcattgtgcgtgtagacacttttatccatattatttagtccaaattctcttttcttgaacattaataataatcaatccacgtgaagaaactgtgtccacatccttgtcacaacaaaaaagccggtaacatctaccgacttcacgtatttttaatattaatcgcagtacaaatgaacagcttgcttagctgcatctaccgttgttgcatctggattcccgtagacgtgaatgggatcaaccggcacgtcttcaccatcgaccaccttgtagccagtaaagcctactggatcgctagttgcatcgaaatagtaaccaccgtggcccttatctgccaaaacccatatttgactatctgaataatccttaagcatccagtccaaacgttcaatggtgtaatcaacgccatattcttttgcctctaaaactaatgcacgtttagttggattagcaggcaaaatatcgacaacattcggactatctgttgcactcacttggcttgattgtgtggcatatgcaaacatccccatcgctgcaactgatgccaataatacttgtttaaacataaaaattctcctttgtgttcccctatgaaatatattcccacaaaggtttgaaaaaaatatgtctatcacttagtaagggcgtcactctcagccagcatccccaagatttcctgctccgttaaatcagtatcattaacgctaatcgttacccaatgttgcttattcatgtgataaccatggtccaccccacgtattttaatcatttcgtccacatgatcaggtgacagcttcaaagacaagtacaaaacaccctcacgttcaaaaatcattgccgtgattttgtcactgccattatgcttcatgactgtccaaacaatcttttcatgtgatgtggatttattgaatggataggtttcgtgagttgcagagttttcgtatacaaggtcaatcaatttttgtttatcatacatgtcagtcactctccaaacgggttttattttaccttatcaaagcgtctgtcatttggctaactctatttttcatccatttatatgatgctatccctttacacaaagtcgtcgaactcaaattcgactatagcctcttgtattgatttaccatccggcaaaacatacgctaatgcttgctcaggagtttcaaaaaacacttgtaaataatttcccttatcaaactcccaaaacgatccaaacggaacaatctctttttcttgttgcatcttttcaggatgccaagggttattatacgaactctccatgccatgataaaagaacgttgcttcaccgttatatgaaagcgactccctcaattcatcaaccgttacagtaaacaagccgtttgctaaatctttcatagttagatattctcgtctacttcaaaaattatttcatctccgacctcagccttaacacccagaactagcgcattataaactggctttggatcgaacagcggtatgctcttcacgtgtacaattttgccgttcaaacgaactgcttggccaatcttcgtattcatcggtaagtcttcatctaaggcaaccagcgttaaatccctaactgaaaatacatcaataacttttgccatacttttctcccgagctcttatttgctttgcgtaaaatgatttgataaccactcagcgattaacatcatcgtttcctcagaattatcactttgaaccatttccaaaatataattccgagccacttcgttataatcctcactcaccggttgatacccattctcctgcaagaaacgcaaaaccacaagtcccgcagtacgcttgctgccatcaacaaataccggcgtcttaataatttgttgcatcatataggccgccttcacccagattgttggataaacttcctggccgaaaacaacttgcttcggttgatctagtaccacctcgaacgcgcgtggtgactgaaccccagcgttaccacctaattcatacacggcttgttcatttaaagaaagcaattcttcacggttcaaataatgtgtttccgtcatccgtttcatctccgtactcgccaagataactatttgctaaaggcattataaccatggtgaaatcatttatgacaacataagtcattccgttcgattctcttcctcacaaaaatgcctatgttagagtcatgttctcgtaatttgccaagcgattcatttaatgattaaagtcccacaacctataccgacaaccgttaggacgacagatataaaactcgcctctttcatactgataaacaaaaaacgccccagccactgcgcacatagtggttggggcgaaccgttatccaattttattcgcttacttgttggattgatcaaaaccaaatgctgtttgatctgtaaattcatatccaggaatcttaccaagagaccaataaattggtgatcggaaagctaaccagaatacaaaaataatccagacaaatccaatcacgtaatcataccaaacaaaatcactcacactgtacaaattcatgaaatagtaaaccgtaactggtataaaccctaagaaagctgtcgccaaaccaggattatacatttctttacgcctcacttcaaagaataccaagtgcatcaaaacctcaagtacgttgaacatcatcatgccaatcgttaaaattttaacctcagggaaagctatggcagaaatatacaccaacaccattaatccccagttaccatacattgagcttaaattattactatcccactttgtcctatctctttcatctcgtcccaatagcaacttcacgcccatgtacggaaacccacctggaaatccaaactcctcaaaaaagtgtaaaaacaagatagcaatggtaatcaattgtacagtttgaagcgcgttccaatcaccaaaaattgccattgcagcactgattactgcaaacattaccgataacaaataccaactattcacaagcttcttcatcttctcaatccatcctttttttattgtcattccttaacacatgaaattataatagacacatgtctggcaaacaacaaacagtctattgcactgtgttgcgaatccaacaaaatcaatgaaagtgtcgaaatacggtaactataaatggctgaacatgaaaatcaacgcattcgtttaactaagcgacttattaaagagagtctttttgatttgttgcaaacaaacaccatatcagatatctctgttacccaccttgccaaaaatgcaggcattaaccgcagcactttttatgttcattatcacgatcagtatgaagtccttgaagagttaggctatgattttgtccacaaaattgctaacgtcacccaatctgaacaaaatttaacacttgctgatcaagtagccgagacaagtcgttatttcaaagataacatcgaacaaacacgatttttaatggcgaacttccaagccgacagtccggtcattcaagaattaatggtccaacgatttgcacaaatttccaacgcgaattctgcattcaacacaaaacttgatgtcgatacaaaacgtctactacaagcattcatggtacaaggtatatacagtttgattcgcacttggattttcgatgacatcgcgaaaacgccagaagaaatcggtcaacttgcagagatcatggcctataaaggctggattcacttatagcccccaatctcctcaaccaagtgttgcggggattttttatgtatatacaaaaagagataccacaataactgcgatatctccaaaattgttatatttaaattttgacaagtgtcctaatgtgtcctaaaacaccgtcagaccagtcataccaagggttggtattagtcgttacgtgtgttacccttttcgtcgtggatggcgcggatcttaccgtcgttctccaagtgaccagttcccgtgtaaggctttacttcgtcaaagaagacacccttctttgcgtagtggtcaagcaattcttgacgtgatgcctcgaaacgtggtggcaaagcgaacgtcgtacccaagtcgaacaatgattcgtccaaggtgaatcctgggttcgtcgtagccaactcaacacggtttccaccaggctcaatgaagtatgctgaacggaagtatccacggtcgataaagacttcgcgcttgtaacccaaagcctttgcacgctcccagaagtacttcaagtcttcttctgactcaacgcccaaagcgtagtggtcagttgaacccttaccgaagcgtgagttaggtgcatcttcagccgtttgaaccaattcgatagcttcaacgccttccaagtcgatgatgttacccttaactgggatttccaacaagtcttcaaagaagcgaccagttgcagcaacatctggcacgtgcaattcagcaccgataacaccagtgatttggaactcagcaggaacatctgacatgtagttaatatgccagtcgaagttcttaccttcagtttcttgcatacggattggcaagtcttcgtaatcagccgtacggatacgtcccattgcatcagcttcagccttcaagcccttttcagcaaaacggtccaaccagtattgcgttgatccttcaggaattgagtagtgaattcctgagaagaacatcttaccgtcagtgcggtcgcgcaagtcgtcaattgggaagaacgtgataaccgttcctggtgttcccataaagtcaccgtagtaaacgtgacggttctttgggttggcttggttaactgagtttttgatgaaacgcattcccaatacgccaacgtagtaatctgcattcaacttggcatcgccagtcaacaatgaaatgtggtgagtcttcataactaacaaccctcttttatctgtttcaatattttttgtttattactttatgtgagtataatacccaacctgctaaaactttgcacgtaaaaagggtcgaattcgaacacaaattaaaaagtcctactctcgcaatctgcattgagtaggacttctatactattaacatatttggggcatcttgatagtttttaattcttgtcgtacttcatttctgaaataaagtaccatgaaagcaaaacaaaggcgatggttggcacaatgaatgagaattgcattgaaccagagaagtcagaaaccaaaccttggaagaatggccagacggcaccaccaataatcgccataaccaagatggcaccggcagtttcggtgtacttcttatccgtcacgttatcaagggtgtgcgcgtaaatcgttggccattgtggaccaaagaagaagctgaccaacacagcagcataaacagctaacataccgtgtccgaatgttgtgaccaacaacgtaatcgttccaagcactgagtaaacactcaatactgaggccactttgaacttgctcaagaaccaagttgccaccagcttaccgatgaaccacatggcgtatgagtaaaccatgaacgttgtcgcatcggcatcactaatgttgtggttcaaatcaagcgccaaacgaatggtgaatgaccaaaccgttgtttgcataccaacatagataaattgcgccaagattcccttcttgtagcggaaattaccagccaagtacttgatcgtttccatcaatgaaacgcttggcgtgttggttgctgccgtgtcatcaccagcaacaactgcaggctttccacttggcatcttcgtaaaggccaaaacaagcaagacaacaacaagtaccgcaatgatgtacttgtatggttgcaatgttaattgcaacatcttctcaccataagcaatgcgttctgcaccgtgcataccggccatcttcgttgccaagttgccaccagtactgaaaatcatgtacttaccaagcaaaataccagcgatgtctccaagtggcgtcaatgcagcagaaatattcaaacgcacattcgccaacttcttagggccaagcattgaactgaatgtatcacatgacgtttccaagaatgacaaaccaatggcaatcgcaaaaatagcgaccaagaacattgaataagttgccacgcgtgaggctgggaagaacaaaccagctccgataatgtaggcaatcaagcccaacataatagcgaacttatatgacgtcttcttaatgacaattgaggctggaatggcaatcaagaaataaccaccatagaaagcagattgcacaaaggccgttgacgcatcattcaattggaagaccgtcttgaattgtgtgatcaaaatgtcgtttagacttgcggcagctccccacattgggaaaatcaaagaaataacaataaattgaaagagtggtgtcttactcaagtaaccgtcagacaattcattaatgtgcttcgtaaaaggacgcacagcagttgcattcgtattatccattgttaccacctaaaaaataacgccactgcgtaaaataatattcgcgaaaggatgtgactcaccggtacggataaccgcacgtgtgttggccagctccttcttgaagtcttcgtgtgaaataaatgtcacctcaacatccggcaacaccttcttaatggcagccaattgttctggattagccgtcttaatttcttcggccagcgtaatgccttctacttccaattcagtcaagacagtctccaacaccgtttggaatgttgggtcttgcaatttaactgctaaatcaatcttttcagtacccattgggactggcaaaccagcatccccaatagccaacgtgtccttgtgccccatttgagcaacaacggctgaaattcttgaattcaaaataccagtctttttcatactattgatatcctttccgataaataatgttagtaaatcgttttacaagatgtaacaatacgcccatcgtgccacggttggcgtaacacaccgcatacttgtgaaaaaacattcaaactttttaatcattttaattatcgaaaaagaaacgactcacaccgatattttcaattcataaacgacacgatttaatttgaaaataaaagttacatcatgtattttgtctaccattcagatatactgtcagtaattaaacatatatcgaggtaaacaaaaatggattacaagatcgaatctaatatgcagttcccattggtgagctatgacttgttgccccgtgaaactgtgcgcatccaaagcggtgccatggtttatcacactggcgacactgaacttaaaggtcgtttgaacgcaaacggcggttctggtatcggtaagttgattcgtgcagccggtcgctcaatggttagtggtgaatcagtcttcattactgaagttacggctggttctcaaggtggtgagttggccctcgcgcctaacgttcctggtacgattcaagccttggaagtcactgccgataagaactactacttaaacgactcagccttccttgcaatggacgggacggtgcaatactcaatggaacgccaatcattgggtcgtgccttcttcggtggtcaaggtggcttgttcgtcatgaagacgagcggtgaaggaacattgttggtggctgcattttgatcaattaaggaaattgatttgcaagacgcccacgacttcaccatcgataacgcccacgtggttgcctgggagacatcattgaactatgacattcaccttgaaggtggcggtgtcattgggtcaatcggcactggcgaaggtatcgtgaatacttttaacggaaccggaaagattttgattcaatcattgaacatcgaaaactttgcgaatgtccttaagcctttcatgccacaaccatcatcaaattaatgacagcaaaaaagacgacgcacatgcgccgtcttttttcatagcgaatcatttaaacgtgactatcacttaattgcgttccagcattaatgtgctgaaaacgctagtcagttcgttgtcgcttttttatttgattattgattcgacggcgatcatcgcgttcccaccaccacatgccaatccatatgattaggtagataaacaacatgtacccaacctcgaagtgaacacccaatttgttagcttcaaaataccaattcgctaacaaaacagtggatattgttaatacaaaatgcaataagaaaagttggtaaaaagcgatatccaggtatctgaatagcgccgagtacaagccgataaacccactcattataagaatagcgataatttctgaacgtttcaaagtgacttgaggaccgacgaagataatcgaaatcatcatgaccagtgatccaattaaatcgccgataacccaccggcgaatcatatcaattaatattttcatgttgccctcctataaccccaagtgtcgcttgagttctggcaaataacgtcgactgacatctatcttaatgcctcgtcgcataaccgccaccatgctaccgctgaaaccagcttctagcgatagcaagccgtctaaattaatgacattctgcttagaaacttgtacaaacagactcgcatctaatttttggagaaccattttcagtgtgccatgggcaaccaaggtttcgtcatttgtataatatgttaacgtctcacctgtcaccgaaatagcaataatatcatcaaaattttttaacatcgtccgatcctcagttggaatcgcgattctgcgctgtgttgtgtcttgttcaaccaactgcacaatatgtgcaacatcagacgaaagtgtcgctgctttaataacaagctcatccgctgccattgtttgatccaactctacccgaatcttcatatcatatttgaatcccttctacgtaatacggcaacgcccaaaaatgcagcataaacaaacaaaaacgctgcaacgatgagcaccaacacgctgaatgattcgagcgtaacgcgattaattgtgaacgtcaatcccagtaggtcttttatgtcgctaggcaaacttgattgtggtattaaaacctgcctaaacaatgtcgacacataaggcgccggtgtaagaccaataatattctgggcaccacgactcaaagtccctactggaatatagacagtcgtaaagaatccagccgcggttccaataattgagcctatacgccctaaagtatcactattttttactggtaatgttaacaaagcgtttagtatcacccataaaacactagtaaataaaatcaaaccaactgtgtgtcctatttgcgctgatgacaaagtgatttgatcaacactagcaaagtaactaaatatcacgataaacaccatcagttgcatcaaaacgccgataatgtacgtggaaatcaaataactcagccgaattttaacttttgacacgccactaactaagaaatcagcaatcgtacccgattctaagtccctgacaaacaaactcattcctgtaaaagttgttgtaattcctgcaactgcaatggttcctgatagcaaccaaaaatctaaaacggcctgtccgttgactacgtgcgtgaagttttgttctaaattgtgttgcaaaaataccaaatacaaaataaatgaaatcaacgctcctaataatgacatgaatacgttgctgggcgaaccgaaatataaggttaattccctacgaactagactaagcatgggtatcctccttcaccaaactgacgaaaatatcgtccatcgtgacagggcgataatcgaaatcattccaagtgggttggttgcctaaaattcgcggcacctcatttggtaacacaccagaaaatgtttgcgcggtaccgtcagccaagttaacaaccagtcgacgctgtgtaaaacgcgatttcagctcctggcgtgacaaagctctcgtgactcttcctgactgcatcatataaacaaaatctgcatcttcggcttcttcaagataatgtgtcgttaacaaaacagccattcccatctctgaacgtaaactgtgaatttgttgccagattaactgacgtgtctgaatatcaagcccagtggtcggctcatctaaaattaatagttctggctttcccaacaacgcgcgcacgatatccaccttgcgcttctcaccgcccgacagtacaccgtacttctttcgtaacaagctatcctctaactcaaatctttctagcaaatcctgtcgccaaacgttatcaacatcagaatataaggcttgcctgaacgccaaatttttttcaaccgtcaaccgactatccaagatactttgttgaaataccacgccgattggcttttgcagacccgatttaacttcaccactagtcggtgacaacaaacctaaaatcattttaatcgtcgttgatttaccagcaccgttagttcctagcaatgagacaaattgacccgccgcaatttctagatttactagctccacgatgtttttacggtttattgtttttgttaagtccttcaattgaattaacatattgctaactcctttttatttgatggactaatattacccaattattcaatggcaaaatcactattttggataacaggttaaaattcacgggtaacttgcttaaaagtatagataattgtacatatcatctaatgggtacaatgaagccatttagacgcaaaaagacggaaccagctacggttccgtcttttttaacgcttaatgcgactgaaaattgagacaccaattacttgtacaacaacaatcaacactgccattggcaaatacgtcgtttcaccaaacaacccgactattggtgacatcaaaccaccaagggcgtaacgtgccaaaccaagcaacgctgatgctgaaccggcgttttcttgctgtccttgcatccccaacgccgtcgtcaaggaaataatcccaccaaccgttgagacaacgatgaacaatggtggcaaaatcatccaaatcgactttggcataaaggcagttgctaacaaccacaaaccgccaataaatgcgacgcggataaaccacttcaacgctgtgtactcaccaaacttggctgcccagcgacctgacatgctcgacatgaacgcgattcctgccccgttaatggcgtacacaattccgaatgtcgtcaccgacaagccgaaaatcttttgcaagacgaatgatgatcctgaaatgtaggcaaacaaggcagccgtcataaaggcttgcgtcaacgcaaatagtacgaattgacgttgcttaaacaacttaccgaaccctgccacaacagattgcttttcttgtggcgctgccttttcagctgacaacgtctccggcaatgagaacaagaccccagcgaacaaaagcacacctagcacagccaagacccagaatgtcatttgccaatcagcccaggcaatgatgataccaccgaatactggtgccaacaccgggaacaccccattaatcgtttggttaatcgcgatttgttgcgtcaatgtcttacccgtaaacaaatcagtaattacggccaatgacaacacgattccggttgatcctgccaagccttgtaccaaacggagaatgattagcatccaaatatttggtgcaaagacaattgctgccgaactcaacgcaaacgctatcgttccccacaacaatggcttacgacgtccgacacggtcagaccacggtccgacaatcacttgccctagcgccaaccccaacagtgacgcggtaatcgtcacttgcgctaatgaagttgatgtgtgcaaatcttgttgcaactctggcaaccctggcaagtacaaatccatggctagtggcgagaacgcgctcaaaacccctattaggaatagctgtagctttccaatattctttttcatatctttcaccttcaactaaaaaacgacccgcaacgagccgttaaatttctattactaagtatagcctttcgcttactttcacgcactaacaaagtgactgataaataagccagcgatgttgaaatagataataactgacgtcaaatcagacagtgttgagataaatggtcccgatgcaactgccggatccacaccaatcttatccataatcaacggaataaatgaaccagccacattggccactaaaatggcaactcccatggccaaaccaactgccacacctagtagcaggtttgctttccaaacccacacaaccaagaagatggttatcccagcagtcgtaccaatcatggcaccaatcaaaacttcagttaacaacattcgcagcaatgaactggtttcttgcaacgcgatacggcgcactgacacggccaatgactgcgtacccgcattaccagcggttccggtaatcaatgaaataaacaccgccaagattgacgcttgttgcaccaaaccatcaaacgtattgatgacactagccgttcccatccccaagaaaatcaagccaatcaaccatggtaaacgcttcgtcgccgacttaaaggggttttcctccagagtgacgacgtcgacaccggccaagcgtgagtagtcttcggcagcctcttcatcaataacgtccacgatatcgtcaaccgtgataataccgaccagcttgttctccaccacaacgggcattgacacaaagttataatcggccatcaaacgggcgacatcttcttggtcatcgctgggttcaacagtaatcaagttcgtgtccatgacatccgaaacgcgtgcttcatccggccaaacaatcaacgaacgcagtgagataactccgaccaaggtttcttcgtcatcaaccacgtagatatatgtaatttgctcagcttcttgcgcagcgcgcttcacggccgtcatggcttgtccaatcgtcaaattctgattgatggccacgaactcggttcccatcaaagaacctgccgtatcatcttcgtaattcaacaaacgacgaatttcatcagcatccgtcttaggcattaacgccaagtacatcgccaattcgcgtggctccacttcttccagcaagtctaccgagttgtcggtgtacatctggttaagcatttgggccgcatagcgtggtgacatttcttccaacaagtcgttcaaatcaacgtcttctggctcgatttcgtcaaagaccgccgccaattccgtcggcgtcaaccactcaatgatttggtgacgtaattgcgaaggcaatgtcacataaaaaacggcctgatcgtaaccgtgcagttcgtcaaagccgtctaagaacgcctcacgctcgctatgttccaaatattgaacaaggtggtgggcttggtcggacagttcatcacgcatctcctctgtgatgtcttccatcatgttatctgccatgaaactatcctccccaatctatttttaattttcgtctggtgtcacttggaacccgtccaagacatcaacgatatcttgtggtagcgcactttgcactgtgcgttccatttgtgcgaatggatcatagaagcgcaaccagtaagcatgcaatgcttgacgggtaatgccgcgatccattggaccaccataaatttcatcaccaatcaatgggtgaccaaggtacttgaagtgcacacgaatttggtgcgtacgacctgtgtgcaattgcacgcgaaccaacgtttggttcccaaaacgcttcactacccagtattccgtttgtgatgggcgtccatcttcacggacctcgcgacgaataaagtcatcatccatacggccaattggcgcatcgatgaagccataatcatcttctaaatcaccatcaacaatcgcatagtaacgcttgtcgactgagtgcgtttgcaattgcttatccaacaagccgtgtgcaaatctgtgcttggcaagcaaagcaactcccgacgtgaagcgatccaaacgcgtaaccacgtgtggcaccaagtcttcagcgcctgaacgcgccaaataccccttcacacggttaaccatggttgtctcacggtcagccttaccaggaactgacgtcacgccagcttctttctcaaccaccaaccagttttcgtcttcaaacaaaaccgtgattggtagatcagacattgccacaacgtcgtttgactcttctggtggcatcacaattgtgaccttatcaccaggcttcacttcatcaacggtacgcacttgcttaccgtctagcaaaactgagcctccaccgcgcttcacaattgaaaacatgcggtgtgaaacgccacgttgtgctaaaaatgtcttaattttcaaggtctcatcgccttggtttgtccaactaaattgggccattagtttacctccgtgccgatgaaacttgattggacacgatgccagaaatgcatgtgtcggtactcagcaaattgaatttttgtttgggcgacacggaactcaatccagtcgatgtttgaggcaatcttgctcaagtggtcgaaactcaacgtcacagcagcgccatcgttttctagttgcacacgaataacttcgtgactaccgataatcaatggtgaaccaagtgttcggaagacacgactgttaattgaggcgatttcagccaattgaattgcttcaagacttgggtgcatcacagcaccaccaatggccttattgtaggccgttgatcctgttggcgttgaagcggttaaaccatccccacggaagcgctcaaatagctcaccttgaatgtaaacatccgccaccaatgttcccaaaggacgcttaatggcggcttcattcaacgccaacacgcgttcttcgcgaccatccgtataacggacgcgtgcttccaacaatgggtacttcaccgtacgtgactcttcatcggccactaggctatcgataagttcaccaatttcgaaatgttgccagtccgcataaaagcccaagtgacccgtgtgcacaccaataaagcgcacaaaagccaattgatcggcataatggtggaacgcacctagcaacgtgccatcaccaccgacagaaatcacaacatctgggtgctcatcgtcaaagacaatgcggtccgtgttgcgctctgctaatttctctttgaacaaggcaacaaccgcttttgattgtgcaccattgttactataaattgctagtttcatgctagtcgtcttctttcctgctacctggattaggcctcggtatgattgtctaacccattgtgtaactctgagaataattcgtcgacgcgaatgcttaattcagccacttcacgcaacttctcagtcatttcttcagtatattcaccgtcgtacttgtaattgatggcgtgttcaatggttgcccacacattcatttgcatcgtacgtacttgaatttcggccaaaatcttcttttcgccagtgattgtttgaactggatactcaatcacgatgtggtaagaacggtacccggatggcttggcattcgttacgtaatcacgttcttccaaaattaccatgtctttgcgttgacgcagcaaatccacaatcttgtagatatcttctgtgaactgcgtcatgattcggacccccgccaaatcttccatgtcttgttccaaacgttctaggtcgatgtgacgacgaacggctttttcctcgatatttggaatggccttaacacgtccagtcacaaactcaaccggtgtcttcacaccagccaattcaaattccgtgcgcataccacgtaacttgaccttaagttcgtccacagcctgaacgtacggttgtagtaatttctcccactcaatctgtgtcatgtcgttatccccccgacttttttctcacttcctctattatagcaaaatggctagcctttttcccgctaattctttgccctaaatacaagacattagaaacagattttcagcattttagcaccaaatgcgctatgcttattacggttaaaaattcacagaacttccacatctcacgcaaaagttttgtgacacttgttgcaatcgagttaagagttgatgttattgcgaattttggagcgtacaaattagacagcgctcggtggaacaggtaatataatcgaggatatgaaaaagacatgcattttttcatatccataagaaaagttttggaggtcgtggctcattatgttagaggtgtaccacttcgtgaacccactttccggtgactgcttagagaccgaaaagaaactagcgacatacgtagaacaatcaaataaaaaagttgccatgcaaatcattccagttgtgacgatgcagtctgctcgccaaactgcgatggcgtcatcaaactcattgcacccttctttgcacgatttgaacgtcgtatcacaaacactttatcaagtggctgttgataccaaggcggctcaattccaaggtaagaaagctgcacgtgagtacttaatggccacccaacaggccctattacagggacacgcctattctgatgagttggtgatgcaaactgttaacgatttggcattggaccaggaaatgtttgtcgaggatcgcaatagcgaccttgccgtgcaagcattccgcgccgatcaaaacttggcagccgaaatgggcgttcgtaacttccctgcattggtggtttacgacactgatcgttctgaatatgccgtcagaaccgatgatttttctgatgagcacttgacccgacttttcttgtcggcaactcgtcagcggctaagagaatatgacggcttcctacacaacggtggcgtcacagaagtagaagaaggctaaaagagacctagcaaggcggtaacccgtcctgctaggtctctttgtttatattcgattaacgcttaaacgtaaaacgtaggccttctactggcttcatatcgcgcgtgtagaattgtactataaattgcgctggctcaaccgtcaaaatggcatacgtaccaccaaggtaagcgtattgtccctttggcaatgaaattgaaccagggttgatgaacaaacggccatcaatctcttcggcgcccaaaacgtgcgtgtgccctgacaagaccacatcaacacccttagctgacgcaacctcacgcaattggttcaatgatacctcagtgtgtaccaagtggccatgcgtttggtaagccgtaaagttatcatccttgtaatcacggtcatctgggaacattggatccgtatccatgtttccgataactggcaacaagtcgttgaacaactcatcagagcgtgacaactctgaatcaccgttgtagaacatggcctttaccttaccgcggtagtgattcacgacatcttccaaaatttggcgatcgccgtgtgcatcagaaataatcaagtaatccatgatttaatcctcccaccagtttttaaactcagtcataaactcacgtaaagcagccccacggtgtgaaatttcattcttctcggctggcgtcaattcggccaacgtcttatcgaatggttcgtagtagaacaatgagtcatacccaaagccaccttcaccacgtgcttcgcgaagaatgagtccgtcaaccttaccagcagcaaccaagcgcttgccatctggcttaatcgctacaatcacagcgtggaatgaggctgtgcggtcgatatcaggcgtactttcaagttcgtgcaacaactttgcattgttagctgcatcatcgtgatcacctgcatagcgcgctgagtagacacctggtgcaccgttcaacgcatcaaccatcaaaccggcatcttcggcaacaactggcacaccaaatgcgcgcgcaatcgtttccgccttaatcgtggcattctcttggaacgtcgtgccgtcttcaataatggctggcacattgtccaattcgttcaatgacacaacttcaataccaagtggcgttagaaactcgcggaactcgcgcaccttaccttcgttctttgacgcaaaaatcaactttgccatgaggccccctttgtgactttagtctgtaacagattcattcaacactagtgtatcaccaacgatatccaagtgcttaactgtcatttccttatcatccaaccaacgaccaccaatcgtagcaaagcgctttacgctaccagtcgtaaagtattcgtcgtttgtgtgatcagctgggtttgctgcagcgtgacgcaaatcatacttgtccaagaactcgacaaccgttgaaatcgtctcggcaccagagttaaccaacgttaccttaggtcccatcgcttcttggatgaagccttccatcaatgggaagtgcgtgcatccaagaatcaacgtatcaacttggtggttcttaaagtacgtcaacttttccttaaccacctggcgagcaaattctgaggtgtagtcgtgattttcggccacatcaacgaattctggtgcagcaagttgtacaacgttagctgcacggtttccttgcaacaaaccattgtagtaagccaatgactcaactgttccggccgttgcgataacaccaatttcaccatccgttgacttacgcaaagcggcatcgacacctggttggataacaccaacaactgggatgtctagcttagcttgaaggtcaggaagtgcggctgcagtcgcggtattgcaggctacgaccagcatcttgatatccttcttcagcaaataattaaccatttgccaagtgaagccgaggacttcatcctgtgggcgtggaccataaggcatacgcgccgtgtcccccacgtagtagacttgttcatcaggaatttgcagcaaggcttgcttgaccacggtcaacccaccgataccagaatcgatgtaaccaattgcacgattatccattatcttcacttctttcgttttttctaagtcttcattataacattgccaggcctattccggaaatctacggtgaaaaagtaaaagacctggtaaaggaccaggtctaatcgcttacttttcagccaactttaaaatgccagcaggtgtttcaaagataatatccgcttcatcgttaaagacagcacggtcacggacaccccatgacgccataccaaacttaataccagcgttgtgcgcagcgtgcatgtcgtgcactgaatcaccgatgtaaattgactctgaaggatccgcatcaaggtcagccattgacttcaaaattggatcagcggctggcttcatctttggcgtttgaccggcaaagacgaaatcatcgaagaaaccattaatctcgaagttatcggcgtgatccgcaaattcttctggcgtgttagaggtcacaatccccatcttaaccccggtcgccttcaagtcagccaacatgtcgtgaataccgtcaaacaacttcacttcgttccagaaatcgtgatagtgactttgccactctttttgcatctcttctgggttttcgatgttgaacttaatcaacgcgtccaatgaaggcaacccgaaaatggcataaagatcttcgtattccttgtgaataccattggcttccaaagtaaattgcaatgacttcatgtacatgctctctgtgctcaacagcgtgccatcaacgtcgaaaatgaatgtcttcataacttggtgaactcctcaatacttagtgccttcattatagcacgtggctagggtcgtgattagtgttgtacggaacgcatgcccacggtcattagcgttaacagaatcactgccaataattgaccaaacatgacgcgttgtaacgcaatccaataggcgtgttcaaccggaacggccaagatgaccccggcaattaaaatgataattgtggcaacccaacaactcgtgcgagtcgaaacgcgctttaaaaacatgtataacgtcaacgtggcaataatagctggcaaaataatcaaaagtggatgtacaccaaatagtggtgtgagtaaaatatcgcttatatatattagtaataacaggatttgaaccatatgtttaacctcctgtgtaaaccataccaaaggcgaaaagaaaaagccgaccctatccaggtcagctaaaaatttcttaatatattgccggcatatcttggccgatttcaaccatctctagtttattcgcagcatccgcaattaatgcgtacgcataacgatcgaactgaactgtttcaatcgctttaccccacttcagaacattagcctttggcatcaaatcttgagcagctgcccaacgtgcaaactcaatcacgatatcatcaacaaattcaaaaccatctaaaccaaataaatcaaacgtttggaacttttggcgtagtacttggcctaacatatctggcgtgatagctggcaaactcgcgtgtgttttaaccgctagctcatccaagaccatcgaaatgatcgcttgcgccgtttccaacccttctggtgttagctcgtcacggttaaccaagtctgtcataaagtcgtgaattgcatcatcgtattccggcacattaccgtcatcacctgaataagctagctcatcaggttcatgcgctagaatccctgtaattagcgcctgtagttccgctgtatagtgaatacgttcatcgttttcagacaccgtcaccacgtcttgtaggaacaacccatttaagccatcaaagaagtcgcgcaccgcatattgggtgtcagcccagtcgcccatttcaatctgggtttcaagccattcgcgcattggtgcaacataaacaactgttaacaccaacaactcttggtgttcctttaggtacgctatgtgcttcttaatcactggttgaatgctacggtgttgtttatatagtgctggcataccgctatcgttcaacacttcaaagaagaacttcacacgcaagtcatcgtcatcagtcgttgtgtcttgggcgaaatcaacattcgtctcacgcaattcatcctcagtcacttccaaccctagctcagtcattaagttctgcatcaattccacctcttcatcatcaagtggttcatcaattgattcttctaagtcatttaaatactcaggcaccgtctccatcaaccaagcacggacgtcaggcgtgaagaaactatcacgaattaggccgcgttcaaccaagttctctacgattgcttccatcagttcaacaagcagccccgtatactggcgatccacttctaagtaccccaacgtcatgcccattgcttggaaaagattgtctggcgtccaattgttaggcacttcattcgtcaagataaaggcataatcaaccgtttgacgcacgaaaatattaacgaagtcatcatcgacctgtttgttatcatgatactttttgactaaatcatcgctgactgacaccgctaaggtacggttaatcatcaacgcagtctgatcaatcggtggtagtaccaagcccccttgcttagcatatgactgtcgaatcaattccgcataatctgctggaataaagttatccgcatcaaacggcatttctgattcatccataatctagaaccccctgtcagtctcttatcacagcagctgttggtctaaaacccctgactttagtcaagcgtaagaccaaagacgcacctgataagtgcgacttggtcacgtcggaggtctataacctctgacattcccagtctgctttatagatgattatacgttgttcaacgacaattaaacagtgattacgtacagtccaaatgtacaaaaaaacagccttaccgaagtaagactgttcgtaaaccattgaagcggacgacgggaatcgaacccgcattcccagcttggaaggctggagcactagccattgtactacatccgcatgatttaattgttttggcatctctgccaatcgcggcgggggggatcgaaccctcgacctcccgggtatgaaccggacgctctagccagctgagctacaccgcgattaatcgggacgacaggattcgaacctgcgaccccctggtcccaaaccaggtgctctaccaagctgagctacgtcccgaacaatattcaattacttgaatattagcaatattaagttgctaatgggcctagcaggactcgaacctgcaatacccggttcgtagccggggtgtttatccaattagcatataagcccataatggacgttacagggatcgaacctgtgaccccctgcttgtaaggcaggtgctctcccagctgagctaaacgtccatgtgcatcgcgacgtcctatcctcgcaggaagcgatcctccaactactttcggcgctattgagcttaacttctgtgttcgtatccagagcttccattcgctcatcaagcgcgaaatgatttatcacgaagagtacaggaccattgatgatgtccgggtgtctgtcgagtggtacgtgaactggtacaacaacagtcgcatcaactcacgcactgattggcttcaggccgcctagaccaatgtctggtttacttaatcacggttatcggcactagccggcacgacgccgtttataagccgtcacttgtgaatttcaaaaattcgccttgtgaaggcttatttgttgcacgataaaaaattgtgaagtccggctagttcacaatctataccacctgttttctctcatcggcagggctcggacctgttccacctacacaaacacccaaaaatcacgccgttttaagctgaaatccgggttttgaaaaattttcggagtccggcacctctcggtgccgaaaaaacctgtccataatcttgacatcagcgccgtatatgaacggccttgattatgcatctcaacaagagattgattaaattcttgtgtatatctaatcatattaaaaatatgctcctatactattattttagggcagagaaaaattgatccgtaaatctagcttaagagcaaacgtttggtctttttagttaattattcactttgcgtttctgagttaccagttagttggtaaaaacgctttgtagttatgtcgattaacttatcaagcaatgcttgcgctgctagttggtctggtattgtatgccagataacccctggtacttgatcatccaatttaacattcgacacatacacgtccgtgtcattggaaaagtgctttgtaattttcagattaaccgaatgccaatccatgatccgttcacgcagcacgcactccagtgatggcatatcaattaaatcaactgccaccgttacaactggcataatttcactaacatccaaagtgaaaacaaatacattgaggtacccattgtaaagggcgttgattattctatcgtgtggcatgtcaaagtacagtgcgattttttttgagcacacggcgtgtaaattcagtatgaattgggtaaacgcgctctgagaattgcgtagttggttgtgttgaaatatcgatcatgcggaagtacagcaatcgtaaattcaatgagaacaatgatttacgaatcatcgccagtttcgctttgcttatcggtactccgaagaagtcttcatagactgttgcgacatcttgaaaaatattttcaaacgtttgtgcgacttctggtgctaaattatcgatacggtatgtaccgaagccaaggccaagtgaataaaatgatactagtccgaaacgagcttcactctcacaccacggttcactcaccatgtgatcagtctgcattgtctctcgcaatgcggcgacaaccttcttggcgttggcagttaagtccttggtcgacttaaagacatccgtttcacttgctgcaatgacatgaccatggcgaattcgcgtcatccagataccaaagaaaatacgtaaggcgcgcttgaccgtcgcacgcattggcgtatgatcttcaaccaaatattcaacattggttgccagtgctgtaacctcatctggaaatggtgatggttgatctgcataggctgtgtaaagcatctcgaataacaaaacacgaacgttgcgttcatcaccaactaattgataattatttgaaatgtgaatgccatacttgtccaattcatcattcacttttacttttgtttcacggacaatagttgtactagatgaatgacggaaaccaatgcttgcatttgaatgtgccacttcaaaaaagatatccatcaacacctcaaagccgagtgattttcggatgtagtaacccatcaaagcgatgtcactaatcgtcctcagttgttcaatatgcaatgcacggttagaatctacaatggacaaatacgatgtgttgcaatcccctatctgttggtaatctatacgcaacattgtcacgttttgcaataccatgtatctcgaccaacctagactgtccataatccccttaatcagcaccacgttactttcttgtgcattgagataacggtgtaatgacaaacgttcttgatcttttttcggtagtagccattccatgatctctgtctctcatttcctttttgtaataaacaacttcagtctattatttttattattttgaattaactgaaatattttgtttattaaaaaattccgctattttggaagcaaacataagaaaagacgactccattacgaagtcgccacaaaccaatcttacgtataccctagggagacattaccgtacagtttcatcctatcgcgaagacgaaaattgtgccgtcgtcatttttaatgatttaattttttcgcgtcaatttgaggtggtgcattcaattcactactaccaagcagtctaaagtactcattttttgcaactaataacacttggcatggtttaacggtactgactctacaaattatcaaacaaactgatgtagcagttcatcagtgtattttatccgataaacacttcatagttaatgtcgtacgcgtataattcgctacattaccatcatggcgaatagggcgcaaccactcccctaattcttttggttcagtcacatccatcaacccgattttaaccaagcgatattcatttttatgccattcatcaatgtgccgtagcaagtccgcaacttctttagcgagtactttagcgtcatcggatacgatccaagttgtgtcgtgctgaaaacggacaatcgtctcgagctcgtaagcgccttctaaatcacgaatatgcccgactgcgcgtacttctgaggcaattcctcagccgtttcaaccagcatatgttgttggacaccgtacaaattgtagcggacatccaaccctttattcggcaacatcgttaacagcggatctacatcaccggtttccaagcctccaatgcgcatcaaatctagcatgtcgttgaccatcaatgcttgcgcctcttcgtataaccgatacattttcgattttgaaaagcccagcgccgttaagcgattaattgaaatccccttgtcgcgcaccgtctgatgcatcagttcaccaaacgtttggctaatcggtttgaatgacagttgatcgtacataatatcatcaaccgggctcaatgactgcgaatgcaattgactgattttgtcttgaattttacgccaagcatccgttagcgagatactcacaaaattcatttgtcgcgtctcgactcccatttggcgcgcagccaacaaaaacgtcgccatcatggcctcggtcaccattgaattgatctttaaaaacgtcgctattaaataaccatagcgcttcaacaccaacaattcgacattcgaatcttggaccggatgatttttgattgccgttaagattaaccacacattcgcgactttcggtatacgtggcttaataatcaacaattgaatcgccctcatgtggatcattaaactcgtctcaaacaagcttcttggcatatagtcctgaatacctacacgctctcaataaacttttggtacagcgttaagaagcgtttaggcgtcaaatcaatcccgataagtgacgtcacgcacatttcaaacaacgaaaatgatttcaatttacgaaaatcgtcgtataacgttttcacatcatcgctgtaatctatcccctggcgacgggccaaaatgatattgataacatgcatcacctgcatgcccaacggaaaacgttgttcatcatacgctgccatcacccgctcacgctcgcgaatcaaatcagcatctggtagttgtgccaactcaccaatattgagttgatatggcttttcagccacaccttccatcaactctgaaaacgaaatcgaaaacagcatttcaatctgccaaagctccaccgcagtgagtgacgcttcgccacgaatgaaccgataatactgcgaacgtgatacaccggcggcttcgatttcatcaattgcaatgttcttttcggcgcgaatctcattgattcgttccgctaaattttgagtccccatgatttctcttcccatcattttcactacgttcatcatacgataagaaagcggataatttatgaaaaaatcccccaatcagctattcaaaccagttttttcgtgtaaaatgagaatatcttaataatagaaacggggaattcttatgactctcgcaaattttgacgttttgtcacaaaagtacgctgatttgattacatcagttggtgttaatgtccaaaagggccaagacattgttatctatgctgatgttgagcaagtgccattggtgcacaagattgttgactcagcttatgcccgtggcgcaaacaacgtcatgattgaatggcaagacattcacattcaacgtgaattcttgaagcacgctaacgaggattctctaacgaacatccctgcctgggtttcagttcgcgcggaagaattgatgggcaagcacacaacgcgcatctcattgatttcagctgatccagatggtcttggttcagttgatggcgaccgcgtgtcagcttaccaacaagcctaccaacgtgctaaccaagccgttcgcaaggcaacgatgaacaacgacgtttcatggttggtcgtggctgcttcaggtcaagcctgggccgaaaaggttttccctgaattgtcaggtgaagctgcaactgaccgtttgtgggaagaaatcttcaagattacgcgtgtcggtgttgaaaacgacgtgattgctgactggatggcccacgttaacaagttgaaggaaaaggcacaatggttgaacgacttgaacttcaaggagttgcactacaagtcagctgttactgatttgacggttggtttggcagaagaccacttgtgggaagcggctgactcaatcgacaaggctggtaacatgttcgtggccaacatgccaactgaagaagtcttcacggctcctgactaccgcaacatttacggtacagtgacgtcaacgaagcctttgtcatacgctggtgtcttgattaacgacatcaagttgacgtttgagaacggccacgttgttgaagcccacgcctcaaccggtgaagctgtgttgcaacaattgattaagactgatgagggtgcttcatcactaggtgaagtttcattggtaccagatccatcacctatctcacaatcagggattgtcttctacaacacgttgattgatgagaatgcttcagaccacttggcgcttggtgctgcttacccattcaacttgaagggtggtacgcaaatggacgtcgaggctcgtaaggctaagggacaaaacgattcacttgttcacgttgatttcatgatgggatcagctgacatggacattgatggtattacatacgacggacaagtcgtacctgtcttccgtaatggagattgggcataatagattttgatagtcattcacgtatttgcgtggatggcttttttgttttgtcgttcatccaccaatacaaaaaagaggtcacaaaggaaaattcccttgtgacctcgaattattattaatgattagcctgcgatagcaacgaaagtatcagtggcagcgttgtaaccgaaaccaacacgtgagacttgtgcgttcaaaacccaacgagtgtgtgggtgtgaaccatcatcatacatattcgtctcattgaaccatgcgttaattgccctagccccactaccaaattggatagcaacaacttcaggtccgtacacttgattccagtgagtactatcaacagaacctgccatttgatctgcacgttgttgtgcaaggttagatagttcatcactaacttctactgggttaaggtgattggcgatgcgaatagcattcaattggttaagcgcctcagcgtatgaaccagtagcaactggtgctgatggtgcagtttgtgctggggctgctggcgtatcaactgatgcttgttgatccgtagctgcaggtgcagctgattgtgcagcatctgatgatacagttgcttgtgcatcttgtgcagcggctactgaagctgcagcagctgagtctgcttgtgcttgttgtgcagcagcaactgaggcagcgtatgctgaatcggctgtagcttgtgatgcagcggctactgaagcggcatatgctgagtcagcagcggcttgtgaagcagctgcggctgattgttcgtcagcttgtgatgcggctgcatcagcgtctgaaactaccgttgcttctgatgaaacaggtacaacaacgatttgtccgtttacagattgaccagcaatgatcaattctgggttagcgataccgtattgtgctgagaagtcttcaactgacatgttcaatgccgttgccaaagcccacactgtatcaccgttttggattgtgtagtttgatacgttaccagcttgttgcaattcagctgaaacttggtcaactgactttgcttgccatgaatcggctgatgctgattggttaccggcgaacataacaccagcggctacagtagcaactgctgcaacgaccaattgcttacctgacttatacatcttgtagtgctttttcaattccatggatatcaattccccttagttcttcaattagttcatatactgttttccctaacgatttacaagtatagcaaaagattttaacaacttcattacatcttcaagaaaaaaccaacaatttttcattgttggtttacaaatacaattcatttagttgcattctgaaggcgttctaatacctttgttgctaatgtaatattggcatccgcctcttttactgaacatttcaatcgcaagacatgattacgcgtgtcaaacgtcattggcgtgcccttgagcaacgctttgatgcgcttcacatcgttatcggacaactcgctctgccctttcgcattcagtaaatcttcaacgaagtaaccaccatccgtgatggctacccgctcgccaagtaaactaactgtctgatagacatataacggcactgcttcgccggtattgtctaggacatccgtatcaatcctaatcatctctgccataaatctcatcctctgtcccccagggtaacaagggatgacaaaatgggacagtttagttttttcacatcatttaaaattacgtggaaaagaagctggcaacggcgccccaatcgactttaggtcattcgtgaatggcaatggaatcttaattgaagccgcatgcaacaataatccaccttcgtaatcatcagttgggttataaagtggatcacccactagtggatggccaattgattgcatgtgcaagcgaatttgatgggtgcgtcccgtttccaaatccagacggacaagcgtattttggtaaaccgtgtgcaccttcgcccaatgggtcaccgcaggaaccgcgttagggccatctacacggcgcgtacggctatcatcaggattttccccaattgctgctgtaatcacccctgaaggctcattgatcgcaccacggacccaagctaagtacgtgcggcggattgtcttgtcacgcaacatttgattcaacatgggcacgacatatggatttttggcaatgattaacgcgccggttgtatcgccatccaaacggtgcaccatatacgccgccttaccttgggcttgcaaatacgcctgggcgaaattcatcatcgtgccgtcttcaccaggcgaatttgggtgtgtcttcacccctttgattttgttgacgaccattaaatcgtcattctcaaacaagacatcaactggttgactatcgtcggttacgtagtttgaagttgccacctcaaaatcatgtggcaaccacgtcatcgtcaaagtatctcctggctttagaatcgtcgacgttggttggtaagtaccatttagcaagatgcgacgctccatgcggaaattaccacgaatgcgacgtggcactagccattgggttaattgttctttaattgaaattgccggttgatcagacggcaagacaatctgcttggtccaagaatccatagcaacctccttttgatatgtatacaaaaaggcaacctgttttaccaggttgcctttaagccgttattacaacttagtaacgttagcagcttgcaagccacggtcaccttgttgaacttcgaatgatacagcttgtccttcttccaatgacttgaagccgtcaccttggatagctgagaagtgaacgaatacatcgtcacctgactcacgtgaaaggaaaccgaatcccttgtctgcgttaaaccactttactgttccttgttccatgtctgaaacctcctggcacattgccaaattttctaataattcaaaaatgaaaatgccagatatttcggtgaaacataaaacaaaatcttttaaactatgtgattagtatagcacgcgtttcctgataaagatatagtgagtttcgaccaattattttttaatttcacaaacccttgctactgttggtccaacagcatatgtttcatgtgcacgaatgttgcttcaagcgtctgtttgaggtgttgatcatatatttcgtagtaaacacgattgccaacttcctcacgcgtcaccacttgttgcttcaacaacaccgctaaatgctttgacacatttggttgtgaaatgccagtttgttcaactaactcgctcacatggaccgggccaggatgcgtcaccatataatccagcaattgcacccgactttcattgcttagcactttgtaaaaagctgccacggcactgattaactgttgttcctgtgtcatcttaatccctcattaaatgctattgcagttgatctccgtgtgtagttcggtctgaatcgtcgtatgcgcgataccgtagtcgtttttcagtgttcgcgtaatctcatctaggtctacgtcgctaaagctctcctggacccccaaatgcgccgttaacgccgcctcggtggttgagatgccccaaatgtgcaaatcgtggactgattttacagctggatggttgtctaggtatgattcgatccccgcttcatcaataccggctggcacgccgttaagcagcaaattcaacgactgcttaaagacatcccaggaactaaccacgatgacaatgccgataaggactgaaacaatggggtcaatccaattccagcctgtgaacgcaatcagtacacctgagaccaccacaccgactgacacaccagcatcagccaacaagtggatgtaagcacccttagcgttcaaatcgtgctcctgttgaccgctctttgcaaagaagtacgctgataggaaattgatgacgataccaaccaaggccacccagatgatgatgtcaccgtccacatggcttttgccgttcagcaacttcacaatggcctcaaaccaaataatacccaccgcaattaacaatagaatggcattcaccgcgctcgccaagatggtcgtgttgtggaagccatatgtgcgcttacgtgttgcctttaatccgaacacaagtactgcgagccacgacagaatcaatgacgcgacgtcactgacactgtgtaaggcgtccgcaaacaaggccgttgatccagctaacttagcaaaaatcatttcaccgatgataaacgccaaattaagcccgataccaattaaatatggcgcttgcttgttttgttcaaattcgtgatgatgatgttcgtgccccatgacatgttcccccgtaatcctaaactaatctatatgccaattatggcatatagattgtgagaattcaaactaaagggcgtaaaaaaatcgcacccggtcgaaaaccagatgcgatttgaataatctattgtattgggtaaaatcttaccaccaaccgttagccaaacggaattggatggcaccatcgattgaaccgtaacgtgaaacggcgtagttaaccaaaccagcagtttgttgtgcaactgaaccagttccccaaccttccttagtttgacccaatccacggtaaccgtttggtgaaacggcgttagggttaccacctgattcaggcataacgattgcgttccacaatgctgaagtaccaccagcagcgataaattggtcgtaaactgaacctgatccggctgccgttgaaacagcaactggtgcagcagtttgttgtgccgttgcggctgcttgtgaagctgcggcctttgatgcggcagctgatgaagctgcggctgaagatgcagcagcctctgaggcagcggcttcagatgcggctacgcttgaagcagcagcggctgatgaagcagcttctgatgcggctgctgaagctgcagtagctgcggctgagttagctgatgaagcagcagctgaatccaagtcagcttggttaacttctgctgaagttggtacttcgatttgttggtcaacgaaaatcatgttggcgtctgagatcttgttagtcttaaccaagtcctcaaccgtcatgttaaacttgtcggccaattctgacaaagtatcaccgttttgtacagtgtatgttgatgcggcgtgaacaacttgttgtcctgctaccaatactgatgccaaaccggcaaccgtcaatgctgtttctttcatcttgttcatatctgttataacgctcctacggattgtttttcatgtgcgaacactattgctcaagcacttctcttaatgaggcttacctcgcctcaaccacaagacatagtttaccaagctgacaaggcttaaaattacagaataattacatttgatgtcgaaaccgaccaaacgacccgattttttcgttacattatcgtcacataggggctgttacacgtgtaaacccgcaccatttaaggtttctcgccgatatgtttaaccggttaagtaacgcgttttttgtaacgaaactcattaaataaacgccaagaaacggttgtttctcggcgtttaacgttttttgtcatattagcgttacgttgaaaagtaatggttttagaattttcgtaaccaaacttcatcaattccatgcccaatcgtcttgtgtagaatcaaatcggcacgttcgcgagttggcaaaatgtagtcaactaagttaggcaaattaacggtttcccacactttcttcgcagcatcaatcgccgtttggcgcggtacttgcgtccatgcgtagaagaaattgtcaggatcatcagcttcagccgtttgttgcaacaacgcttcaaagcgatccaaataccagtgttcaatcaattctgtctctgcgtcaacgtaaattgacaaatcaaagaagtccgacaagtaaactggtgagttcggtgccgcttgcaaagtattgataccttcaacaatgaagatttcaggtcgctcgaatgtgtcaaactcatctactagtacatcggaaatgtcgtgtgagtactttggtgaacggacaacttcctcaccatccttcaccgcattcatgaattctagcaatgctggcatgtcatatgactctgggaaccccttacggtcaaacagcccttgcgccttcaattcgtcatttggcaacaagaaaccgtccgtcgtcgtcaaggcaacgttatgctcgccatattccgcttgcaacataaattgtagcaaacgagctgtcgttgacttaccaacggccacagaaccggcaataccaataacaaatgggcttggctttgtaacacgccccaaaaagcgttggcgttcttcacggtcacgcaagtattgcgcgtggcgtagcttaatgtagtgaaccaatgggtcataaaacattgcaacgtcagccattgaaatttggtcattaaacgccttaatctcacccaaaacagatggcgtaacgtgtgaaacgtcacgatccactggtggctcaactaaaactgaccaatcatcgcgattaaataccgcatagttaagtggtgcctgactcatagtcaattaccccatttcgtaaagttgtgaatccacgtttgccaacaatggcgttagcttgttaatcgcaagaaccgtcaattggtgcatagcacgtgatgcaatggtgtaaaccagttgacgctcgtcatcaccgtggtataccccttctgaggcatcccacataatcacggcatcaaattctagtcccttagccaagtatgcaggcacaatgatggttcctggtaccaagcgttggttttcagtgcgaataattgtgacatcagcttggtcacgcaaagaagcataagcagcttctgcgtcagccaatgtcttggtgatgattgccgtcgtctcttcagccgcatcattagctgccaattgtgacaacgtagccgcaatcattgcatcttgatctggcaataccttaaccagtggcttgtcgccttcacgttcgaaggcatcgatttgcgcaccgttaatcaagattgcctttgagtagtcagtaatttgttgcgttgaacggtatgtttgcgtcaattgcacatattcagacttctctggatcaaataagtgtgacaactcttcttgcaagctaacggcattttcctttgtaaagatggcttggttcaagtcacccaacatcgtaaagcgcgcgcgtgggaagctaaacttcaagaaggccaattggaatggcgtgtagtcttgaatttcatcaatgaagacaaagcggatatcacgctcaccacggctacccttaatcaagtcaaacaacaacataaatggtgtcatatcagccattggcaattcaccattcttcatcttgttgattgtgttctcaacagacttttgccaatcatccaacgtaatgccgtatgcagacaagtccatcaactttggcaccgtacgcaagaagtgaatgaattgattattaatgttaatgaaacggttgcggttaacacccttagcaatcggtgccaaagcattcgtcacaataatcttggccaagaactttgtctcttcttcatcagacttaaactcgcgtgggttgtcccccaacattgagtcgtattgttccttcgtcaagttttggatttcagcttcaacccagtccgcttgcatttccgtcccgatacggccttgcaacatcttcatcaaacgttccttggttgcttggagacggttacccaacttgtagttctcgttgaatgagtagtaaatctcttcaatcttggcctttgaaatgatttcttgaccacggaacttaattgggcgcatcttgatgtcggccttgttcaaaccgtcagcgtatgcattcatcgcgttgaagtagtcactggtacccttcatgtcgatgatggccttttgagcgccttctggttgcgcttcgaaacgctcttgtagtgtctcaagctgcaacttaggcaaacgacgtgatgcatattggtagtacgtcatttgcaccatgttttgctcacccaattcaggcaacacttggtcgatatagtcattaaacaattggtttggtgagaacatcacaacttgaccagacgtcaagtgaccacggtaacggtatagcaagtaggccacgcgttgtagcacggcagatgtcttaccagaaccagcggctccttgcacgaacaacaaatcagctgccgtgttacggataatcttgttttgttccttttgaatcgtcgtaacgattgacttcatcttcgtcgttgactcacccgaaacggcgttcaacaacatttggtcaccaaccgcttcgtctgtgtcaaaaattgtgacaatcttaccgtcttcaatttggaattgacgcttcaagtgaaccgttgcctcttgcttaccatccggcgtctcatacgttacttgacccaaaccagcgtcatagtaaatagaagaaattggtgcacgccagtcataaatcaagaaattgtcaggtgaatctgagaatgatgccaacccaatataaattggctcaaccgtctcagaaccgttttcttgcacatcaatacgggcaaagtatggacgagcttgcaagcggtccaataccacggcttggtgttcaactgagttcattgccaattcgcgttcttgcaacatttgttgttgttggcgaacagacatggccgtttcgaacaagctaccataagtagatgacttgaagcggacgtcgttccatccagcttcaacatcagcttgcttttgctcgttgttttgtcgatctaaatcattttttacctttgcgtcttgaatcttttccaagaccacatccaagcgttgttgctcggcttcgtatggttccatactgggtcccctccagctaaaattagtgattccatggtactacactttaaggttatttaccagagtgtttttgcagggtttagtttgtatgcgggtcgtcgcttgcgcgccgaagcatggtgggtggttgggctggtggtgctccgtcctgcaatataagctggtggcaacggggtcccgttctcactaagcctcagcgtgtttcaacgcctgtcggcttgaaatccactgctgctaagtgataactggtgcccctttccttgcttagtcaccggctaatatcgcaggatctccgcaccaccagcccaaccacccaccatgccagcagccaagatattctatgttcgtttgatagtcatagaaaaagttccccactatatatagtagaaacatctccataacaaaaatgcttgccctacatttctggtagacaagcaatttaatttagcgttaaaacgcattggctaaaacataatctcaagattgtacagcaaaaattatgccgttaaagttgcagaatcgaatgtttccagtgtttttcaatctagctgaaatgatttaaatctttcggaatcggcacgttcttgacgattaacgttttcttatttgtaaggaatttaaacgtagcttcgcttttattgtcaatatcatattgcccggtaaagaaaactgcgacatttatgcctgagtttgctggaacattgacaggaaattcagttgaaaaaattggattctgatagtcggttccatctcttaatttataagacttcatcgtaatgaaatgcttaagatcttttcctgaccacatatttccggttgcttcatctatccaatcaatgtgtgaaatgacgattgaactagaggagttgttaacaatttgcattcgcacgggagccccataactggaaccaacagcagcaattgcaggctcatagctaatgacacgtactgtcaaattggtacgagaagatacccaacgccgaatctcattgaatacggcataaataacaccaagcgttgatataatgagcgccaaatcaatgtggccgtcgaaagtgaatttcatgactgatttcctcgttttacgtctagtatacctctaataaatccgttcatataaccacacaaacaaactagctgatatttcgtccacttgtctgataatcacagtcaaaatcccactctatatggtggaaacagctctataacaaaaaatcgcttgccctacatttctgttagacaagcaatttagaattatcgtcaatattaatcttcttgtgcgtaatcagtaacaatcaagtgctccaagaagtcgcgtgcgtctgtttcgtcggtggtgccggctgcgatttctgcttcgacagctgccttaatcttttcggtaactgctgcactttccatatcagctgcaatgacatgaacacggtggaaactgtcagaccaataaacctcagttggtccccaagtgttcaaatccaacttctttacccaatcttgaacttcttgctttgtgtatgccatgataaacacctccaactactcatacgtagcgttttttatttcttttttattacatgattagtatagaacaaccgaaatctaatggcgaaaataaggtatccaaatttgcgtcagaaaataaacaacttgaatctattttttcagacgccagatatatatgattttttgcataaattcagtggatattcaaaacggcaaagtccccgttatggagactttgccgtttgtttttaaatattaatcttcttcgattgccaattcgatgtcttctacgtcatctgctgaattgtcttcagcagcgtcgtctgaaccatcgtggcttccgatgtacgcttcgcgaacttgtgcgtagatatcatcgtaaatatccttgtgttctgggtcttccaaccaacgaataacgttgacctttccttgaccaatcttctcaccgttgtatgagaaccatgatcctgacttcacgataatgtccttatcggcagccaagtcaatcatttcaccagtctttgagatacccttaccaaacaagatttcaacttccacttcacggaatggtgctgcaaccttgttcttcacaaccttgatacgggtaacgttaccaactgacttcacatcgtcaccgtcagccttggtagcatcgataccacccttacgacgaacgtccaaacgtactgatgagtagaacttcaatgcacgtccaccaggtgtcgtttctgggttaccaaacatgataccaatcttttcacgcaattggttgataaagattgccgtcgtgccagtcttcaagatagcacctgacatcttacgcaaagcttgtgacatcatacgggcttgcaaaccgacagttgagtcaccaatttcaccgtcgatttcggccttaggcgtcaaagcggcaactgagtcgacaacaaccatgtcgatggcacctgatgtaatcaaggcatccgcaatggccaatccttgttcaccagtatctggttgtgatagcaacaattcgtcaacatcaacacccaatgccttggcgtattcaacgtccatggcattttccgcgtcaatataagcaacgattccgccgttacgttgtgcttcagcaaccgcgtgcaaagccaacgtcgtcttacctgatgattcaggtccgtagatttcgatgatacgtcccttagggtaaccaccaattccaagggccacgtccaacttcaatgatccagttgacgttgattgcaccttcgtgaattggctatcaccaagcttcataactgaacccttaccaaaagacttttcaatcttcttcaaggcttcgttcaacgcagcttgacgttcctttgggtccgcaatctttccttcaagcttcttatttgggttaatgttctttcctgatgccatttttatcggcctccacttgttaacttaaacttaatatacacctagtgtaacctaattcaatttagaattcaattctttttcgtgctaattcgcgatttgtttgattttgtctgccaataagtcaaatgctgccgcaactgattgttgacgaactcgctgacgatcgccatcaaatttaaacttcgttgccgctactgtaccatctggggccgcaatcccaataaataccgtaccggctgggtgaccttccaacgcatctgggccagccacaccagtgaaactcacaccccacgcggtcttcagttcacgttttgccccgctcgccatgctctcggcaacttcagctgacacaacacccactttatcaatcaaatcggccggcacgccaaccaattgcgtctttgcagccgcagcgtaggtcacaaatgcacctggcaacacagctgaaatgcctggcacctctgctaacgtactgacaaacaatccggccgtcaacgactcggccgatgtaatgctctcgtgtcgcgcaatcaaggcttggccaacttcaatatttttcattctgcacccctttcaataataaagacgcagtaatcgctaatttttccaattttcgtttgattcaattgtataacaaaagaggtagtccaacacaacgagtgtcaaactacctcttcattcatttttttacttgaaaccgtcagagaaaacgtcgcggttcttgtagaaataatcaattcctgagtagattgttgcaagcaaggcaatccaaatcataatcattgcaaatgagatgttgaacatcgcaaagacaatgtcgtgtagcaagaagaatgagatagcaaccatttgtgatgctgtcttaatcttacctggcattgctgctgccaacaccttaccattgttttcaacaatcaacgtacgcaaaccagtgatggccaactcgcgaataacgatgatggcaaccatccaagctggcacccagccgaattgaacgaagaaaatcaacgccgtcataaccaacaacttgtcagccaatggatcagcaaactttccaaagttcgtcaccaacttgtacttgcgcgcaatctttccgtccgcaaggtccgtcaatgaagcaacaataaagataattgctgcaactaggtgtgtgactggcaaaacttccccagccacttgcaacgttccccaatcaagtggcaacgcaagtaccaacatgaaaacaggaatcaaaatcatacggaaaaccgtcaacttattaggcaaattcattctttatctaccccactaagtttagcgttggaacgtcatgtttgcgttccaaacgatggcgttgttgttcatcaagttaacgtctgaaccatccaaagacatcttcgtaaccgttgcgttaccgattgaaacgctgataccagttactgaagcaggaatcttaacatcttggttaccgttagcttgcaacgtaccgttccacaaaacagtgccggctgcatccttcacttgaatccaagatgctcccgttgacttcaagttcaacgtcatgtccttgtcagctggtgccttaacggcagcgtacgttaccgtgttaccagttgccgcacctgttccaaggtcaaccttgttatcatccttcttctctgatgattccttctttgaagactccttcttagaagattccttcttagaagatgacttctttgattcgtcagtcgttgactttgactctgaagatgatgaaacagatgacacctttgaagttgtcactgaaacagatgattcgttcttgctttgttgctttgctgaaccagcaaatgaggcaacaacagcccagataacggcgatgattgcaatcacagcaacaccaatcaaaatctttggcatcatttgacgtgtcttatcagcagccgtctcttcaaccttgtgcatccccgcgcgagtcacgttatccgcgtcgacgcgagcaccactcaaatcaggttcaaccgtttctgtggtgatgtcatggttcttcataaaatcagcaacatcaagtccaactgcattagcatattgacgcacgaatgcacgctcgtaaaatgcccccggcaattgatcaaattggccattttcaatagcagctaggtagcgcttttgaatctttgtcgtttgttgaatatcgtcaagggatagccccttatcaagacgagccttttgtagctcttgtccgatgacgctgttgcgttcttcgttcattagtctctcatccttaactattttttatcagtataattgcatatatctatactaccacatattatcgacattcggacgcgcaataacggtcgaaaggtcactaatttcggcatgcataagtatgtcataaacgctttgcacatcaaggctctgcaagacattaatttcatcacgcaatgttgcaaaatcaaaggtcttcccttcaaatcgcgtgacaatttcttcaagttgattgaacttactaatcaagcgacccaaggcgtcctttttcaccaattcaaaatcggcagacaacgctttaaaacgctcagccaagttcgctaattcatctgaaacggcatcaatcaattcatcagcttcaggtgtttccgctgcaatggtcaagaaggccacgcctcgttcccagtcaaattcggcgctgaatgtatcatcaatcatccccgagtcataccacgtcatataagttggtgaaaactcgccaaacaccaaatcaactgccaagctaccggcgatggcaatgcgtaaagcatccatccccgttggcatcgtcgccccatcgtaccaacgttggccgatagcgatttttgtacgcacgatatccatatcaacttcaagcggttctgtaataactggcgccagtgtcttagttggcactgtaatattcgcgctagcttgacgtgaactaattggtgcatccatcacaagttgacgaacagcatccacatcaaaagcacccgcaacgacaatgtccatattttccggacggtagaacgcatcgaaggcagcctgcaaatcagccggcgtgacgctgtgcactgattcggtcgtaccagcaatatcgtcagccatcggatcaccagggaacaattgacctaaaattagtcgatacaagcgggcgttcgtatcatcttgatacatatccacttcttgtgaaatgatatcgcgctcacgcacaacggaactttcttcgaaataaggctcttgtgtgaaatgcaacagttctgagaaagccgcatattcattagcaggtgctgtcatgaagtagcttgtgcgagtctgcgtcgtgaacgcatttgcattcgcacccagttcactcattcgtgaaaaggcatcataaccaggttgcgcaaacaacttgtgttccaaaaagtgtgcgaggccagctggctgcttaaccaattgaccatcctgcataaacatttgatcacgcgcaccaaaatcaaccgtgaccatccccacaaattggtgaaaatctggtcgtggcaaaatatgcaaccgtgccccgtttggcaatgtttcatgacgctcattaggcgcaaaacgactcaatgcatcaaccattatgccttacctcctaccaattcatagtgcagttgttttgtaactgcttgggccacttgttggacctgttctgccgtcactgaatcaaccgctgccaaccactcctctggtgtcgtgcgataaccaatcaattcttgattctgaacacgttccgtaatgcgaccaggttggtcaagcgaaaccacataatcagccttcatcaaacgcttaatcatgtttagttcatcatctccaactagttctgtttgaaggcgcgtcaattctgcatcaattcgctcctcagcttcaactagcttggcgtgatcaacacccgactccaccatcagcaaacctgtatagggattgtaatctgaataaattgagtaagctaaaccggctgtttcacggacattcataaacaatcgtgaaacagcaaggccaccaaacaatgcattaaagacgaaaccttggaaacggtctgactgttctagcttcaattgataagccaaaatcaaacgagcttggttcaccttatcaagttccaccgtacgctttacagctgggaataagtcttgttcataataaggattcccagcgatggcacgtggttccaacggcaattgcgccactgcttgttcaacagttgcagtgtccacatcacccaatacgataatatccacacggtcgtgcgccatggtgtcttgccaagcatcccacgcctcttttggtgagaccttttcaaggattttggttgtgccataggctggcacagcttgcactggatcggtgaaataagcattaatcgcttggcgtgccgcgtagaacggcttctcttcttgtagcccagcgatttcatctaaggcaatttcacgctgacgttcaaaaacagttggatcaaagccttgttcggcatcacccaatggattgcacatcatctcgcgaataaacgcaaagccatcgcgcaacaaactctgtgaatccgttgcaaaatcatcatgtaccaacgtcattcgcaaacgtagtgtgtgcaatgctcccgtcttcagtacatctgtcccaaacgatgccccgtatagatcactcaacacacgcgccaacgcagtctgtgagggatatttttgtgaagctgtttcaagcatgttacttgccaacacgcggccacccaatgaggccacgtcatgttggcgagtaaagttaattaaaattcttgtcgttgcaaattgctgagttggcaaaatatgcagaaaaacgccaggttgaacggttactgtagtcactgacataccttcttttccaaactaaaagcgcgctggtaatgaacgcgcttgttttttattgtcgtacaattcgagtctgcgaactcgtcatagtaacgaatattttgtgcagaaactaatactataagtataaacttctgcgtcctattttaccaactcaatttccttggtcgtcagcttcttccgatgactctacagccactggatttaaacgcatatattcagatacaaacataaagacgctcactgctgccatacccactaataagacaacaacactccatgtattcaacacgggcgctgtatagtgcaataggtacaaaacaaacagaatacccgtcaggttgtaccacacccatcggacccatttattatgccaaatcatcatgatactctccctgaatcacttagtttgtgaaatatttaatatgtttatatttacaaataaaaaagcgcaaacttcgattaaagtttgcgctttttgtgaattgacgtcagaagtaagtaaaattttatgagaacaatgctgacaaaatcaagataacaatcaatccaacaactgaaataattgtttcaagcactgtccaaatcttcaacgtttgtgggacatccaaatcaaagaattccttgaacatccagaatccggcatcgttaacgtgtgaagcggccaatgaaccggcaccgattgccaataccacgaaggctgggttaacagctgtttggttagcaaccaatggtgcaacgattccggcagtcgtcaaaccagcaaccgtagctgatccaactgagacacgcaagataacggcaatcaaccatgcaaagatgattggtgacaatgacgtgtgtgagaatgctgaagcaatagcagttgagataccaccagcagtcaagatacccttaaaggcagctccaccaccgataaccatcaacaagttagcgattgacttcaaagcttctgacattgatgaaccaacttcacccatcgtacgtccttgctttggtcccattgaccagatagcaaaggccattgcgataaccatggcgataactgggttaccaagcatggcgataatgcgatcaagtaccgttgggtcagtcaagtaaccgtgttgtgcagcaggcgtcaaagccttccaggctgcatcaccaaccataccactgtaaacttgcttaccaccgttgtgagccaacgtgtaaatcgttgaaatcaacatgaagaacacaggcatcaatgacgttacaagtgacaaaccaaatgatggtgtgtcttccaacttaaaggtcttaacttcaccaatagcatcaagcttcttggtaatcttaaatgcctttggctcaaccttttgaatcaaacgtgtgaacaaaggtccagcaaccaacattgcgacgatggcaacgatgataccgtacatcaatacgacaccaatgttagcacccaatgcgttagtaaccgcagttggtgatggctgtggtggcaagaatccttgtgcggctgacaaagcagcagccattgggattcccaagtaaagcaatgacacaccggcttccaaagcaattgtgaagacgataggaatcaaaacaaccaatccaacttcaaatagcaatgaaattccgatgatgaatgatgcaccagcaaccgcccattgcaactttgacttaccgaacttgttaatcaaagttgaagcgatacggtatgaaccacccgcatcagaaaccaagcgaccgatcattgatccaaacccaaagacaatgaccagctcacccatcgtaccaccgataccattcttcaaggcatcagcgattccggctgggttcatacccaagcccaaggcgaccaaaattgaagtaatgatcaacgcaacgaatgtgttaatctttgccttcaaaatcaaaaatagcaacaatgcaataccaactaccaaaatcaagaatggccaaacgttaaagccgtttgtcatccattggaacaatcctgtcttaggatcggtagttaggccagcgagtaatgtaagcatctcgtcttaccccttctcaattaaaaaaatatctcaaatgtgttctgctcatgaaaacgatttcataagtcaacttaaatattgtacaccttttgtaagcgcttgcgggtaataagttcattaaaattttaatcagcgttatttcattgtcgggataccagaataaaaaaagtccgattttttggtttgttttttatacgggatataagcgtctgaaccgttttatggttatttgcattctgtgaaaaatatagtcgtgtcgtgctaacgcacgaatcgtttttgggcgagccggggcggtgttccgtcctactgaattagctggtggcgacgggaacctgattttcctaagtcctggcgtattcccgcgcctgccggcttgaaatacacccatactaaggaacctctagtttcccttccttcgctttgagcaccggctaattcagcaggatctccacaccaccccaactcacccaaaaacgatggcaatcaagttattcttgtctatctgtgattgtcatctgccactaaaaaaaacgtgagaatagttatccttatcagttaaccgcggatgtttaacaaaaacaacagagaacatctcgattgctggcatggtgggtatgtgtgggtggactcggagctcctgcgatattagccggtgaccaagcaagtaaaggagcaccaattatcacttagcagcagtggatttcaagccgacaggcgccgaaacacgctgaggcttagtgagaatgggactccgttgccaccagcttatattgcaggacggagagtccacccacacatacccaccatgccttggcgcgcaagcgacaaccggaagcacaaaaaagctcacacagcaaatgctatgtgagccttaattgaatgtttatttcgttatagcaagataactgccattgccaagataacaaccatacccgtcaatgagatgattgtttccaaaacagtccagatttggaatgtttgcttgattgacaactcgaagaactcttggaaaatccagaatccagcatcattaacgtgagatgcgatcaatgatccggcaccgattgccaaagcaaccaaaactgacaaagttgggttgttttgtgattgcacgattgacaatacgattccggcagccgtcataccggcaaccgtagctgaaccaactgagatacgcaatacagccgcaactgcccaggcgaagataattaccgtgatagctgacatgtgaccgttagctgagaacaatgaggcaaccttgtctgacaaaccaccgtttaccaagacaccacgccatgctcctccaccaccaacgatcaacaagataccagcaactgcgctcataccgttgttcaatgatgcaccgattgattgggctgacttcttttgccatacacccattgagaagatggcaaagatcaaagcaatcgtcatagccacagctggcgttgccaagaactcaacaaccttatcgaagtttgatgggttctttggcgtaacaccacccgtgtagatcatcttgtaaaccgttgcgatgatcatgaagattaatgggaatactgacgtgataactgacaagaagaatgatggcgtcttgtccaactcgtattccttaacttcacctacagccttgatttccgtcttaaattggaatgcatcaggggcgtacttttgagccaacttcgtaaacaaaggacccgcaacgacagccgtaataactgacacaatcaaaccaagaatcaacgtcaaaccaatgttagcacccaatgacattgccacggccgttggagctggctgtggaggcaagaatccttgtgctgatgacaaggcagccgtcattgagatacccaagtaaagcaatggcacaccggcttcgatggcaaccgcaaatacgataggaatcaaaagcaccattccaacaccgaagatcattgagattcctatgatgaatgaagcaatcaaaacggcccattgcaaacgcttaataccaaaccagttaatcagcgtcttcgcgattcggtatgaaccaccggcgtcggcaaccaatcgaccgatcataccaccgaagataaagataactgagtttgatcccaagatattacccataccttggtcgcccaatacagcgtttggaacatccattgggttcatacccaatagcaatgccaagatgaacgccgtcacaaccaatgaaacgaacgtgttcaacttgaacttaacaatcaaaacaagcaaaatcaaaattgaaattgccaacataacgaattccatcgtttatttactccttaagtaggtaaaatagctatttaaaatagattgctcacagtactggcaaagtgtcatgcactgtgagcaatgtttttatctgcttttcgctcaggactacttgtcgcccttgtttacgtgcttacgttggaagttcgcaatgtttgcgtactccgtttgcaattgacgtgccaaacgaataaagattggcgtcaattcgcggtaagcttcgtagttttctgggtttggatcgtacgtgtttgagtcaccgaccatgtcgccgataacatccaaactatcaaccattcccaaagccttttgtgccataaccgtagcggccaaagcacctgactcgaaggccgttggcaccgtaactggttgctcaaagatgtcggccgtcatttgacgccacaaagctgaacgagcaaatccaccagttgcttgcactgacttcaagtcaccaacaacttcttcaagggccaaagcaaccatgtagatgttgaagatgataccttctagcacggcacgaaccatgtgggcacgcgtgtggttgtgcgtcaatccgaagaatgaaccacgggcgttcgcatcccaaattggggcacgctcaccacccaagtatgggtggaatagcaaaccatcagcaccggcaggaatctttgatgcgatttccgtcaacaagtcatacgtatcaacacccatcaaggcagccgttgacttctcggcgtcaaacatcttgtcacgggcccaacggaagacatctccaccgttgttaactggtccaccgacaacccagtgatccttatccaaggcatacgtgaacgtacgtccctttggatcaatcttaggtgcgtcagttacgacacggatggcacctgacgtaccaatcgttacagcggcaacaccaggctgcacagcgttaacacccaagtttgacaaaggaccatcaccagcaccataaacgaatggcgtgtcgatatccaagcccataacagctgcgtattccgcaaccataccacgctcaatctcgtatggttcaactggttgtggcatttgctccttcttgatacccgttacttctagggcttgctcatcccaatccaagttgaagatgttgaacatacccgttcctgaagcaattgaaatatccatcttgttggcaccgaacaaacggttgaacaagtattccttaattcccaagtagtgggcagcgttgttgtagatgtcaggcttttcgttcttcaaccacaacatctttgacaaaggtgccattgggtgaattggtgtacccgtcttgctgtaaatctcttggcccaagccagttgacttcaactcttccgtgtacttaaccgcgcgcgtatcagcccaagtgataacacgtgtcaatggttgccaatccttgtcgaaggcaatcaatgagtgcattgcagaactgaatgatacacccaaaatcttaccgccgtttgcgccgcgaacaacctcagtcatagcatcaacgaaggcttcccaaatctcgtttaggtcctcttcggccatgtctggttcgtcacggtaaagcttgtaacccttgtttgcactggcaataacatgcccttccgtgtcaaacaaaacagccttagttgacgttgtccccaagtcaactccgatcaagtattccattgtaagacctctcaaatcttcactaatcttaattacttctgaatagtactttactattttatgtaaaaacctttcacaatgcaaacgttttccgcgtaaagttttttctcattatccctgtactggtacatttcattaacaaaaagaatgtacaacgcgtcacaagtacgcaccgtacattctttttatatattataaatagcctttttcatctagcacagccaatgaatgatctgtccaggtatccaacttcgcactgtgaatcgttaattcgaagacaatttcggtagctaagtcttcttcgctcatgccatcaaggtagccatgaacttggtcgcggaataaatccgtcactgcttctaaatggtatggcgcctgcacaatcgaaacattgttgctactgattgttgccccgtcacgggttggtggtgtaaaaatcgccaccgcactattcgtcaactcagcaattttcggtgtatctggcgctgatgccatcagccaaacgtttggccggtcaggcactttgacaaagcgcatcaaccgactgctaggctttccgtctgatcgaattgatgacaaaattacctgatttgttaggcgggcatatcgctgaaacttttcgacacccgctttttgcaaacggccaacagtttgatcaatgtgctcgattgttgcgtcgaccgattcaaattcatgctcactgtcgatgtaatacaaaatttgcggaattaacggtccaatatctcgtcccttgtaatagaactgaatccaacgacgcccagcgtgtagttcacctgagtaacgacgcctaatcttggccgattgacgtttgaaaaagcgtttcatcgtgccacactctgtcaatttgtgcatgataaacgacatgattataagcaagccgacaaatatcaaaacatcgacacgtggcaagccttgcagacgacgattgacatccagtggtgaataaatcaaaattgccatcaaaatcaccgtgctagccaatgtgccaaccagcgttgtgacttgtttaacccgtttttggagcctaaaaatcttgttggtggttacttggcggcgcttcatgtgatgctcacgcaacttcatgtgtgccactaattgttcatcatatggtgtcatagtcatccccatcagctatttcaaaatacttaaagcggtctcgtaattcatatgtttccacgtcgtcataaccgaccacgcggatactttgacgatttgtcctgaacgcttgcggaccatatttcgtgtcgtacatttcttcggctaaactgacgcgatacgcaacccgatcagcatcaaccgtcaacgcatcttggtcacgcttctcgcggtattgattaatcaaatacagcacaaagaaaataatcacgaagaataaggccatatccataaagaattttgtcgcaaattcccacatcttaaacccttctgtatatgaccagatggcatgccctttttgaatgtatttggcaatcattgtcttaaccgttatgtagaccggtaataacatgaaaaacagcccaattatcgctaatagcgcttgccaaattttagtgattaaccgacctttaccgaaaaaccagtcaatcgtgatgtcattttcagttgattcgtgtgtaatgtatgtcggctttgcacacttctgatttcgtctagttagcatggcttatctcctcattaatcgtggcgagactctttgaacgctctggtgacttccaaacgccaccttcatcaccagtgagcactttcaaaaatgttgggataaactccgtcaccatcgctgccgtgttcaccatccagtacaccaacaggtaccatggtaaaaacaataggtacttcagtgtcttaccgccgtcattcatgtaagatgccaaaatgccttgcacgacgccgacagcaacttcaatcgtgacaaacatcgccgtcatataccagccatgcacgaagcgctcccaattacccgtgaataggaaatatgcttctaatgctaagaataaaaacattgatatccaatagaaaaaactccagacaatactgaaggcataatcaatgataattggcatagtggcgaggttcttaattggatgcttcaataatgaccctgttttagtcagcaagacataaataccgcctgacgcccaacgacgacgttgcttgaacattgcgcgtaaggtttttggcatatctaagaagaagcgaatgtgcggtgcaaataaggcttgccacccattcgtttgcatatcccaagcaatcgcaatatcttccgttggttgctctgcttggaagccaccaacatcgaaaacagctgctttgcggtacatcgtattggcaccggaaaaggcaaataagccaccatacgccatttgtgatcgcttaatcatgccgacaatcgaatttaattcattcatctgcaccaaggccgttgatgttgtgcggtttgaaaccagcatatttcccgtcactgccccaacattttgcccaccttcacgtttgaaataagacatgtatttccataaggcgtccgtttcaggcttggtatccgcatcattagacagaataaattctcctcgtgcataaccaagggcaatattgtatccatgcgctttaccacggttatcaacgacagttaggacacgtaatttgctaggaaaacgcacctgcaactggcttaggatttcacctgtcgcatcagtcgagccatcgttaatcactaaaatttcatagcaatgatccggataattcagttgcgtcgctaaatacacaatggttgattcaattgagtcttcctcattatgagcaggaacaaaaatactgacaaatggcggttcaccatcaaagtatgctggtaactgtcggcgctcgttaaatacgcgttgataaatacttgaaatgataaacgcgatgcccccaacaattgggtaagacactagcaccaataccagaaaatcaacaacatggttgaatatccaatcatacataatcctgtacacctccgttcattaataggttggttgtcctaatagttaaacattaatgtgacaaagaccttctgaaattccagatatcaacacaacatcgcgtccgttcttggatattttttgatattaaaaaagaggtgcccttacagcacctcttggtctatcttatttggttggtttgtagatggcacggttatccaacgcccattgacgttgtgaaaactcgccaggttcagtttcggccaaagcgttatcaaaactttgaatattagcatccaattcatcaagttggtgcaaaatgtttgcttccttaactactggacgaactggtgagccatactccatcaacccgtggtgcgccaaaaccgtgtgacgcaacaacagcatttcttcactgtacaaatccatgttcatttcattggcagctaagacaatttgctcgtcaatcaagacgatgtggccaattaggttgccggccgtcgtatattgtgtggcgattggtccggtcaattcaatcaccttgcccaaatcgtggagcaaagcaccggcatatagcaaactagcatccaagccaggatactgcttcacaactgcttgcgccaaatgcacaatcgacaaagtgtggaagcccaaaccacctgcaaacgcgtggtgattactcttggcagctgggtacttgtagaacttgtcgtggtacttcgcaagcaagtgacggacaatacgttgccacgtggcattcgtaatttggaataaaatcgctgagacttcttcttccatttcagaagccttcattggcgcagcactcataaagtcggctgggtcttgtggttcaccagcatgcgttggacgcaatgacaacacctttaattgtggcttgtcttgataaacctgacgaactgccgtcataaagacaaccataccactcttcaatgtgttcgcttcttcttgcgtcgcatcccacttcataccacgaatttccattgaacggtccgccactgaaacggccaagtatcgcttaccttgttgggtcacacgcggatcaacttccttcaacagaacgtaaatctccatgcgttcatcaacttgatattcttttaattgttttgcttctgtcatttcgaagccccctttaattcgttcaaatccaacacgttgtccgcagcgacttggtgtgccgtgaagtacaagacttgttggtggttgcctgccatttcttgcagcatatcaatcatagcttggcggcgttcacgatcgaaatcaacaaacgcatcatcaatcaacagcggcaattgaatactttcttttaccgcttgcacgaatgccaaacgcaatgcaacataaacttgctccgcggcacccttcgacaactgactaacattgaagaccgccccatcatgacgcgttactttaattaaagtctttgtttgtgaaatttgcgtatagtttccttgcgttaagcgttgcaacaaatcgccggcatagtgaatcaattgtgggaatcggtcaccgatagcagcatccaaggttttcgccacccattcattcgccaagcggttcacgaaataagccttcaaatcagccgtaatggctgcggtttggtcagcgatttgctgttgttgggtttcgattgacgtatccgtcatcaaacgttgttgttgcgcttccaatcgcgccaacgtttgttgcacgccattcacttcttcttgcaaacgcaatgctaccgccgatggatcagtgtcatcaactgtttcactagccgttgctaatgcgttcaaatcagcatccccaagttgtccacgcaacaagtcagcttcttgcatcattgcttgggtgcgtgctgctagttcacgttgttgcaacagttcaccaacggatgtgacacccaacacttgcagcaactcattcaatcgttgttgcaacttcgccttttgcaccacttgctggtcagccgtgcggttattcgcccgcaactcagctaacttttgacgataatcactttcagacaattggtatcccaaccaagccaacttctcttccaacgccttatgttgcggcatcacggcttgttgcgcagccatcaaatcagctagctgttgcgccatttgatgacccaaacgcacatcaggttgcgcattcaacaccatttctggtgtcatgtcaccgtattcggctggcaaatcagtcgatgccgtcacgcgcttaggcaacttgaagaacaggaatgccccaattgcacctaataggataatcgctaagattcctggcaacacttggtgaccaagcattaatcctagcccagcgacaattccaaacgcgatggccccaatgccggcacgttgatattggccagaaacggcgatttgtggcccaccctgtagctggttcacttggaatggcgtgagttctggtggaaagactcgccaacggtacttcgccagcaacaaactcgtttggttttgaatatcagcttggcgacgagcggcttcacgttgttgttgattcaattgttccaacgcattaaccgcttgggtagcggcatccaactgttcatcaaataccgtcgcttcaaccgacaccgtttctagcgctaataattgttgttgcacctgctctgcttcgtcggctagtcgcgtatcgattggctctggtgcatctgcaagttgggctgttagttgttgccagcgttgataaatcggcaccaactgctgttgcttagcctgtgatgacaaatcggttgacagattgcgttggcgctccgttagcttggccaaacgcgcttgggccgcctgttgttgctcagatagtgcgcgtaatgaaggacgtgttgcaatcgcggtttgcaagttatcttgagcgatttgcaaggtttgaagcgcttcgttgatcggacgacgcgctgttttggtgaccccgaattggctcaccgcctcttgctcccattgatttgcaatcgccaaccattgttctgaccctggggtcgccaacaaacgcaagtgttccgcaaattcgtcaggtcgtagcgcaaagatttgcgttagcgcatcctgatcgaaactaaataccgcttggtacaagtcacggtcaaccggtcctaacaactcagttagcatcccctctgggtctgcaaattcttgttgcgtctcaacggctaccaagcgcgttgtggtttgcgtacgtcctaaccgcgtcagttcatatgtcgtgccattcacttcaaattgcagatgaccaccataaggtccctgctcaagcggttcgtaagtattgaccttacgccctttagcttgcgggaatccgaacagcatccccaacaagaattggtgcaaggttgttttacccgcttcattcagcccttgaacaacctgtaagccatccacgaaatcaaaacgttgctgttgccattgaccaaatccgacaatggttgcatttttaatccacatccgtttggcccccttgttccgcaacgcgtagttttgtttcaactgcttctttgagttcagccatcatgtcagctgacaaaaacgacgtcaaaattgatgcgtcagtcacctgcttcaatcccaggcgttgtaatgtttcaaagtcaaagactgcatcagctgtttcatcccaataatgttggtctaccgctggcaatgtcgcttttagcggcgtgctatctaaccgcacatcaaacacatagaacgcatcattcgactgtgacgcccgcgtcaacgctgccaccaattggccgttttcaatcattgataacaattgtggctcatcagtctttactgttagtgacaccaactcaaattcttctggcgtccctaattcgcgacggatttgtgtcactgcagtatttaaatcacccatcaacgtgatgtcatgcgttgcccacacaatcggtgcaactggtgtaaattctggtaccaagtgcgacccttgattttcaaccaagtagtaacccttagtcccactttcattgcgattaagtccttgcaaacttcctgaataaccaacgaacggttctgcctgcaaggtttgacgcacgtgaatgtgccccaacgcccagtagtcatagtgatgcgcttgcaaatcacccaagctgaatggtgcataatcccccgccccatcttgtcctaccgatccgtggtacatcccaatgtggaacgccacaccaggtagcttgtttgggaacttaattgccatgtcttcagtaatatggcgcgttgtgtatgagaacccggtgatggcaactttctcaccaccagttgtcgttaactgcgttgttgtgatgtcagctggcaacaccgtgacattcgctggccaaactggcaatgcttgccagtcttgcacaaaatcgtgattaccaaatcccatgacaaccggaatatttgcttcatccaaacgttgcaaagccgtcaccaacgtcaattgcgcacgtgtgtcaggcgtcgttgtatcaaataaatcccccgccaacaaaacgaaatccaccgattcagcgatggcatcatcgaccaagcgggccaacgctgtttcactggccgtttgcaaattattttgtagccatgccggcacgttagccaaccccacaaacggattacccaagtgcaaatcggctgcgtgaataaatttcatgcggtccaccactcctcttaaagtctttgtgttctattatccctgattagtcaatattaggaaatacctaacatcgtttcttaacctttgcccacaagaaaaggcgtcgcaaaatttgcgacgcctttatcatattgattagtcttgaccgtacaactcagcgattggcttcgtgatgatgttgttgatttccatcaacaattggttaacagcttgctcagcttccatcatcttcttcaaagaatcgtgcttgtccatctcaccagcaatttcttgccattctgcaacttgcgcagcttctggctcttgaccagcttgcattgcttggttgatttgcatttgggcagcttggaagcgttggaacacatccttagcagccgcgtcggcgttcaatgcttcaactgcatcacgcaacgtcttgtattgagccgtctcacgcaaatcagtagcaactgcgtttacgttgtcataaatgttaatcatattaattaatatccttctttaaattagtatttccattatcgcatactttggggcctaattaccaaacagactttgaattcctgaccatgccgcttgagcaccgtccttcacatttgaccacgcctgacttgcgccatccttaatgtctgattgaataccgtcaatggcatttgagaagccatctgatgatgaactaccattggtctttccgttttcgccagttacggtgctcatcttttgacgcacgctcttaacgccgaatgcggtttgatcagtgtttggaattacttgctccagtgtcgtcttcatcaacggtccagccgtctgaccaagcgataccggaattgtttcaccgttagcagatgaatcgtaacccgtccaagttgtgaccaccacatctggtgtgtaagcaatagcccatgaatccgtcgcgttcgttgccgttgaatcgctaccggttacctcggttgtacccgtctttccggccaccgtgtaaccatatggatcagcagactttccagttccgttcgtataaacgcccatcatcattgacgtcatttcatcagcaaccttctttgaccaaaggcgtgtctgcttttcctttgctgtgacaactaccttgccggaagaatccacaatcttcgtaatgaagtgactttgactcatgacaccgtcgttggcaaaacttgtgtaggcttgggtcatttgcaacggtgtcacacccttttgcaaaccaccgattcccatcgccaagttcttatcggacttcttcaatggcaacccagccttaattcccgcattgtatccaacggaaacgcccatttggtcaagcaaccaaacagctggaatgttgtatgaattttcaagtgcgacgtacattggcacatcttcactggtgtaatccgcataattcgatggtgaataaccattcgtaccaaaactagtcttctcattcttcaactcggaatcatatgagaaaccacgtgatagtgatggtgcataatcaacaatcggcttaatcgttgaaccaggtgaacgatacatgctggttgcgcggttgaagccacggaagacgtgttccccacgtccaccgactacggcacgtaccccaccagttttcgcatccatgaccactgacgcagcttgtgaatcgccaccaattgggttcaaccaactggtctcataatcatcttgcaagttttgttgatccgtttgattcaatgtcgtataaatcttgtacccatcgttcaagatttctgattccgtcaggccatatttgttaatcgcctcatcaataaccgcatcaaagaaatatgggtaattgtaattagaattatcaacattgtggtcggttgcaccaatggcagtagctgcatattgatccgcttctgtttggctcaacttcttatcattcaccaagttttgcaaaacttgattacgacggttcagcgcattcttaggataattcaatggatcataaccgtttggcgactgcaacattccagccagcatcgctccttgggtcactgacaaatccgaagcgttaaccccgaaatacttcaaagaagcgtcctgaattccccagacaccttgaccaaagtacgcattgttcaagtacatggccaaaatgtcgtgttttgaatattccttttcaacctgaatcgctaggaacaactcacgtatcttacgtgtgatggtttggttttgcgtcaaaaacgcattcttaaccaactgttgcgtaatggtcgatccaccagccgacgcattgataccacgaatgcgataccaaactgtcgtcaatccaccacgaatcataccggtaactgagaatccaggttcatgatagaaattacgatcctcggttgccaatacggcattcacagcattcggtgaaatcttatcaaaggcgacatacgttcccttttgaccagcaattgagccagccttattatcttttacatcatatatttcggtggatgattggagtcgcgtttttaagtctgacacatccgttgttttagcttcgaaagttccgagaacactaattaccaatatcccagtcagaataaaaacacctatccaacgattaatttggaatcgtgtccaaaacggtccaaacttgcgtcgtatccacgcgaaaaatgctttcattcgcatcatcatattattgcatccaatttgtaaagcgttgggctaactgctcagccgcctctgcagatggactcgtcacgtaaatcgtgttgtggccggccaatgttgcaatgacttcagacaagttcgctgcgtcaatcaaagccgccaaacggtttccgttaccttgtgtcgtcttaacaaccgtcataaactcaacgcgcgtcacagacacagcggtctctgcaaatcccttttggacttgttcgctatcaacaactggcgcatctgacatcacttgataacggggacgtcctgatccgtcggcacgacgaacgatgcgcatctccttgatatcgcgtgaaaccgttgcttgcgtgacttcaatgccagcggcttgtagtgagttcatcaaaccttcttgtgaatcaatcacctcgcgtgacaaaatatccaaaatcaacgcttggcgttcttgcttctttaatgccatggttttcaatccttctttttttgcatatataagtttaattatacaggtttttcggttttctgccttaagttcgggcggaatcaaaaagacgctacccgccttaattggcaagtagcgtctgtcatatttaattacataaacaacatacggaagatttcttcaaacatgaaaccaatcaatcccgcagaaggcaccgtaataatccaggccatcacaatgttcttcaatgtgctccacttcacggcacgaatatcatcagaagcacccgtaccagcaattgctgacgtaactgtgtgcgtcgttgaaattggtgcatgaacgaaataagctgaaatgaacaacacggctgatgaaacagcttcagcaacgaatcccttttgtgggctcaagaccgtaatcttgcttcctagcgtgtgaataatacgttggccaccagccattgttccaactgagatagccaaagatgccatcaaaataatttgaaacggaatttccgtttgtcctggcgtaatgccaaagaaaccaactggtgcggctgccataaacatcaatcccattgacttttgggcgtcttgcaaaccgtgtcccaacgccaaagatgctgatgtgaaaatttgcgctgtacggaagtacttatccgtttccttcaaattagccttcttgataattttattcaaaatcaccatgatgagtagcgctagtccaaatccgacgactggtgacaacaccattggatcaataaccttttcaacgaccttagccaacttgatgtgaacattgttaccggcgatttgttcagccaaaccagctcccatcaatccaccaatgatggcgtgcgttgatgaagatggtagaccgaaccaccaagtaatcaagttccaaccaattgcacctagcaaagcagcaataaccaagaacaactgttgctcggcactcacctgcgtcatatcaacgatgtcacgtgcgataactgcagcaacggccgttcccatcaaggcaccaatcaagttcatcacagcagccataatgattgctgtcttcgccttcaaggcacccgttgtaatagccgtggcgattgcattcgccgcatcgtggaatccgttaaccccatcaaagattagggcaacgataataaccaccgttgctaatacgtagacttccatgtctttctctcctgaaatacatattacttttaatttcttatttgttaaaaaacaacagaaataattatatcagtaaatacgcggtttcttggattttgtaacaaaatttacactgccgttttgtgccgtaatgtgttacaaagcggtcgagattataaacatactttcatcataaatatgaattacgatgtgtttaattagcacagaaaagaaacgtaaccatgacttctaaaccattactctataccgctattgtgaccgcagcactagcagcaggctttattggttcaaaatttgtacctgcccaatcgcattctgaaacgtcacctagttcgtcatcatcagtcaaatcatcagaaaaatctagcacgagcactgccatctccgaaaaagaaagcgtagcctctagtgttgtcgctacaccatggtcaactgagaaaagacagcaactagctgaattcatgtcgaattggcaaactgaaatgggacaaagctatcaagaatattatcccggccatgattttgatttatatggtctcatgttcccatcatcgctcacagatgacggccaaacattacgccctactattaataagcaattcattgatatgcaatggtcggctgatggcaccggcaatcatgactataacttggtcgctgtatatggtggcgatgccagttcgaataagcaagatccgaaactgacgatgtatctattcactcttcacaatgggcaacctgaagttctcgtaacacaacaaaatcaaggtaatcctgaaggtcgcttgtatcttaatcctactgataaccaagcccttcaagccggttttgattcaattattaataatgactaaaacagcaggcgccacagataaaaatccgtggcgcctgctgttttttgcgaacgctctctaattatgaaacatcctgaaccaaatacccattgtgcagttccttttgttcaccaaggatcagctcgactgagtgattaaagagtggtccatcaaaaataacagtatgatattcaccagtttcgccacacatatctgccccagttgcagcaatttcatctaatgtttgttttgaaagtgtggtccctaggaacttaccagataattgtttcgtatcaacaactgtcactaaactcttaaacccagcatccacaaactcatacgctaacgtttcgcgatcagtttgccaaagtggaaacactgaagttaaaccaacatgttcgcatcgctcttcacaccaacggcgattctgttcaaagtcaatatcaccaaaaataaccgtggtaataccaccctctttgtatgttgctaattgcttttcgaaatctgtcgcatagccagccgtccaaaaatttgtggacacgacatcaatcggcaatcccagtgcatcaccaatcttagtcaacacatcttggtgtgttccgtgaacccacgaacgattattctccgcattcatcgttgtaaaaagtcgttgtacatcatacccggattgcaaagcgcgatgcaacgcaagcgtacaatcctttcccccgctaaacgacacaacagcctttgtatccatacttatcccccaactgtttgattattttagtatacatcatgaaaagcacatgtgacttcgtgatcattaattaatccagcaccttgtaaaaatgagtaaacggtaactggcccaacaaatttgaaacctagttttttcatggccttcgatacttgttgtgacaaagcatcttgggctggtacatccccactatgcacaatctgatgatcaatcggcgtgttatcaacaaattcccatagccatttggcgaaactaccaaactcacgttgcacgcgttgcatcgctttcgcattattaattgtcgcgagtaattttgcccggttgcgaataatgccagcatcccgcagtagatcttcaacgtaagactcatcgtattgtgctaccttatcaatcacgtaaccttcgaaacgttcattgaatcgttcacgcttatcgataaccgtttgccaacttagtcctgtttggtatgtttccaaagagagcaactcaaataatttatcgtcatcatattccggcttgccccattcagtatcatggtacacacgcatcgcttcatttggcggatagttatctacccacgcacatcgttgtatgctatccataagcccctccccgcttttgtattaacacccatcatacagaaaaatcacccatcgtacaaaactgtacaatgggtgatcggatttcagcgctatttaattcttatgttcagcaacataatccacgaaatcttggaataccttcaagtgcgtggcatcatgatcaaacatcatctcagggtgatattgcacaccacgaactgacgcgtcttccgtttggaaagcctcaattgtaccatcgcttgcataggcagctggcatcaacccatcccccaaacgcttaatgccctggtggtggaatgaattaacaatcggttgatcgccaaacgtccccgccaagaaggtgcctgccattacatcaatgcgatgcgttggctcataccacttaaccggatattgcatgtgcttcacaactggttgcccattcgccggtgtatattgcgtgttgatatcttgaatcaaggtaccaccaaaagcaacattcaaaatttgtgacccacggcaaatccccatcaaaggcttttgttgtttacgagcttcagcaataatcgccaattcaaataaatcacgttggcgatccgtttcacccatcttgggcgttggatcttctccataaaacaacggtccaatatcttgtccaccaattaacaataccgcatcaacggcatttacatattcagccgcttcctctggtgtgcccatcggaaaaacaattggcaaagcaccagcctcacgcaaagctgccgtgtaattctgctgtgtgtaatcaacgtaattcgtaccatgctttggatttgcatggtttaagtgattacttggaataccaatagttgtcacgtttcccccccacatttcattgacaaaagatacgttgaaatattagacccatatgcgaattacgtcaattaatattgtcatttactacaacgcataaaaaaaggcagtcgacctcgtaatgaaatcaactgccttaatcatctaattacatttcctttggcgccttaacacccaacaaacgcaatgactcagtcaagacttgtgaaacagccgtaaccaaagccaaacgtgcgttcaattgaccgtcgtctgccaaaatctttgagttagcgtagtacttgttgaatgtacgagccaagttcaaagcgtactttgcgataactgatggttcgcgatcacgccatgcgcgacgaacaacatcattaaagtcacccaacaacttttcagtctcccaaacgttctcatcagtaatgacaacatctgacaaatcaagttcagggttaccagccttgcgcaagattgattgtgcgcgggcgtttgcgtattggacgtatggaccagtatcaccttcgaaacgaaccacttcttccaacttaaagtcgaagtttccgatacgctcgttcatcaaatcgtggaacacaacggctcccgttccaacttcgtgagcaaccaattccttgtttgccaaagttgggttcttctcttcgatttgctccaaagccaattcaacagaatccttcaaaacatccttcaacaagatgatgcgtcctgaacgcgttgaaagcttcttaccatcaaccgtaatcaaaccgaatgggatgtgctcaacatcatctgaccactcgtaacccatttccttcaacacggccttcaattgcatgaagtgctcacgttgctcaccaccaacgacgtacaatgacttcacgaagttgtagttcttcttacggaagatggcagcagccaaatcacgcgtcatgtacaaagtagcaccgtcagtacgttgaatcatggcaacgttcaagttgtacttatccaagttaacaacttgtgcaccttgagattcaaccaacaagccttcttccttcaacttgtcgataacgccgtccatcttgtcgttgtagaaagcctcaccgttgaatgagtcaaactcgatatccaacgtctcgtaaagctccatgaattccttcaatgactcttcacggaaccatgaccacaattgacgagcttcctcatcaccgtcttccaacttcttaaaccaagcgcgaccctcatcatccaatgctgggttttccttagcttcttcgtggaaacgcacgtagtacttaaccaacgtgttgattgggtcagccttaacttcagcttctgatccccacatcttgtaggcaaccatcaacttaccgaattgcgtaccccagtcacccaagtggttaatcttgattggttggtaaccgttggcctttgaaatttcagccaatgagtttccgataaccgttgaacgcaagtgacccattgacattggcttagcaatgttaggtgatgacatgtcgatcgttacgtgtcctgcttcaccatccgtgttgtgaccgtattcttggttttccaagatagcgtgcaacacatcggcaccaaagttttcttggttcaagaagaagttaacgtaaggtccggcagcttcaacttgcttaaagtttgacgcatcgattgcctcagctacttcagctgcaatttggttaggtgccatgtggcgttcctttgccaacaagaatgttggaaaggcaaaatcacccattgatgaatccttaggcacttcaacctttgacaaaatcgttgcttcatctagttcaggcacaaccgcagcgacggcttgagccacttgattcttgtagtccatcggttactcctcttcttcctcttcttcagcatcatcgtcttcaatcttgatgtctgcagggatttcttcttcgtcttcctcttcagtttcatcagccttacgtggtgctgggttgtccgtcttcaccaaaatcttagtttctgacatgcggacaacagcgcggtggttgtattcgttaaccgtcgctgtatcttctgggtcgttttcagtaatcaagaccaacaatgagtgttcgtaaatcttttcaacgatacccttaaagtcgtgttcgaagttggcaaacttcttaccttcaacgaagtcacccaagtcgaactctgacgtattttctgcaggttccttagccatggcactatccccttttaatctctgcacatttaatgcatttattcactgttttaaacataaaaaatcaccgatactatcggcaattctgtatattataccaaattttgtgattaaaaactaggcttccaattcgttaacaacacgttgtgcaactgcccagtcattctcatatggtgtatcaacgccaccaaccttttggtattcatccaatcccttagccgccaacacaaccacatcatttggaccggccgccttaatcgcttcggtaatggcaattgtgcgatccatttcgcggttaatcacaacatccttgttggtaatggctgcttggatttcatctgcaattgcattcggatcttcgtattgtggatcatcactggttaggtaaacgacatcggcgctttcactgaccgcttggccaataccaggtcgacgtgacacacccttgttaccaggtgcaccaacgacaatcgtcaacttttcgactgtttcgttttgacggacaaagttcaacaacgccgcaattgacgcatagttgtgcgcgtagtccacgtaaattgtaccgtgattagctgacgtcaacacttgcatgcggccaggaatcttaacgacttctagtccttcacgcatggcatcgggatcagcaccagtcaaacgtgccgcgatcatcgcagctacggcgtttccttggttgaagtcacctggcatatccaagtggtattcaccagcaataccaagacgttccgcttgttgaccagcttggcgaaccgcaaacgtgctaccttgcaagccggcttcaacggtttcgtagtaaacgtcagcctttggtgaatcctcatcttcgcgaccgtatagccaaataccatcacgtggcacagccatttccgcatgttcaatcaattcactaaagtggtctgaatcggcattcaaaataatttgttctgagtgatcgaacaacatcatcttgtgttccaaatagtcctcaaacgttgggtgctcattttcaccaacgtggtctggactgatgttcaagaaaatacccacgttgtaacgcaaaccataaacacgttccatcttgtacgcttgtgatgacacttccatcaccatgtgcgtcatgccgttatcaacggcttcgcgcatccaacggaacaagtccaatgactctggtgtcgtcaagtgggcgcgatagtggaactttggatcagctcccgtaatgacttgcaacgttgatgacaacgcaaccttgtcgttcgttgccacacgtagcatttcgtgagccatataagttgccgatgtcttacccttggtacccgtgataccaatcaaagcaaggtcgttttgtgggtaaccataaaacgccatactcaaaatactcatggccgctgccacgtcatccaccacccaagttggtagtgttgtgtcatggacaaaagtttctggggcgaccaatgctttaacacccttttggatagcatcagtcaaatattcagccttaaaacgacccttaataaagagcaacgtttcaggttctacatcgtttgaattataggctaaatgcttgacctcaccatcaaagtttggcgctgaaatcaacaaatcttgatcggccaacaactcagtaatttgttgtgctgtgagttccatttatcctatctctcctcttcattatctatctatattattattgccattcaccagctgctttaagctgttgcaaaatcataatggcagcgcgaccacggtgagcataatgcacacgctccggcatgtcgatttcagagaatgtcataccgttttctgtgaccatcaactcatccaagccgttgcgcccaccacgtggttcagttgccaacgtgataccaccgcgagcttgactgaaatacgtcttacccgttggcgaaatcacgacaaagtcagcttgcaaataagctgttcggtcagcatcatctggcaactgggctaaaacatacgcgttaatttccgcatccccacgtaattggtgcgcctgaaactcgcgcatcgtggtcacaccaaaatgatccggaatcgccggtacaaacaacgctgaatcatcggccaaaatgtattcatctggcaaaatttcatggattgtttgcgcctttacgcgtgcgttttgagccatgtcgtcagtcgtctcatctggaaaggcgatttgctcatgtaggtcacgataattaatcgcttcaacacccaaaactgccagataatcaaccatttctgccgtcttatgtgaattattcgaggcaattaccaatcgctttaacatgtcttacatcccttcagattcaatcgcgcgtagtgtgtagaatgaaccggtaaccagaatcaaggcttctgatgattcacgaacacggcgcgccaacgtaatggcagcacttgggtcgtcggcgatttcaacgtcgacattactcatcatcacaatcttagcggccaactcatcggctgacatcgcacgatcagaatctggcgtaacagcgattaccgtatcaacatggggcaacaattcttccaacatgtcgtggtaattcttaccctttagcaaccccaaaacaacaactggcttaaatggtaggtgccatgaacgaattgacgcgaccaaactaatgataccgtctgggttgtgcgcaccatcatacaaaatgttgcgttctgcatcaaattccatacgtccttgaatcttaacgtgggccaatgcttcagcgacgtctacatccttgatttcaaagccacgactcttaaggaccgtgacaatttgcaaaaccgtactcaaattattggcttggtaagcaccagtcaatgacaacttcaacccttcgaattggtcagcattcaagaccaagccacttggtgatgattgcacaatcgtaatcactggcttagggtttggattccaaattgcgcctacttcttctgccttatcgtgcaacaagtggtacacttcaatatcttggcctgggtaattgacgatacttgcacctggcttaattgcccccgccttatcttgcgcaatttcaagcaagtcgttacctaataagccgacgtggtcatatgaaatcttggtaaaggccactactaatggcttttcaatcacgttagttgcatcacgcaaaccaccgacgccggcttcaagaatgacaaaatccatttctttgcgggcgaagtaatccaaagctacgagtgtccaccactcaaacttcgatagcgtatcttcgtccccgccgtgtgctgtgacttcttctaggacacgcttgtagctgctaacgaaatcagcctcactgatcatgtcaccattcgttgtaatcacttcacggtcgttcaaaatggccggcgttgaaaagtgaccaaccttatagcctgctgtcaccaaaatcttggccaacataacaccggttgaacctttaccgttagttccaacgatgtgaatcacacgcaacttgctttcaggatgccccatccagcgcaaaatttcttgtaacatgccaacacgattaccagcttctggtcgaactcgccaagggccgtccatcttctttgtaatctgttgataagtctcagctgtacccattttttcctgtccttactatatatagaagattttgaagtgtacaaacacacattacgtgttggcattcgctataataatgccaacaaactcgcttttctaatggttaattctaccatataaagcgacccgcggaacaattggacgaatcttttctgcgattgtccttctaaacaagcaatgttcggatatataaaacatgttatttatttcatatataatatgatgacattttcatttgtcattccggacaaaaactgttacattgttactcgttattctatttttactttgaataagtaagtatgcatgaaaggaatggcatatgttaagcgttgatcacttgacggttggctatgaatacggacctgttttcacagatttgtccctttcttttaatccaaatgagcttatcggtattatcggacctaatggtgctggtaagtcgacgctcatcaaagcgattctaggaattattcagcccactgccggcacaattacctatgacgatacgccagttactgggcgtgtacgtcgcgataaattcgcctatgtcccccaacgaagcgacttggatttagattttccagttaatgttttcgatttggtgatgatgggcgtgctatcgcaaatctctcgttggcattcggtcggtaaagctgaagaagcaatcgtccaaaacgccctcgagaaaatggacatcgcccacttggctaatcgctcattaaacgagctttctggtgggcaacgtcaacgtgctttggtagctcgtgctcttgtacaagatgcagatgtctacctattagatgagccgttcgttggaatcgacgtggcctctgaagcacaaatcatggatgcattgcgagatttacgtgatgccggcaagacaatcatcattgtgcatcatgacttgagtaaggttgcaaactactttgactcagtcatcctgcttaaccacggtctactccgtcaaggaaaacccgaagatgtgatggatgccgccactttgtccgaagcatatggtgatcacttaattatcatggatcgtcataatcacatcgtacaaggaggttaatatgtctgcgttactgaatttctttcacgcacttggtgaatatacctttctacaaaatgcactgattgctggtgcgatgattggtttaatcgccggtattattggtgcatttagcatcttgcaaggtactgctttgattggtgacgccatgtcccacgcagtcctgcccggaattgccattgcggctttgatgggcatcccctattactggggtgccggtgtgttcggcttattagccgctttagtgattaatttcatttctgaacacacaccattaaaaacagatgccgccattggtttaacgtttagtacgttcttcgccttaggaaccatcatcatgacagccgggcattcaacaaccaagctaaccgatattctatttggaaatattttggccgtttcaagcggtgatttgatttctagtttggtgattggcttgattgtcattgcggttgtgacgactttctatcgtgaattgtacttaacaacattcgatcgttcatacgcacaggcacaagggattcacgctaatctattccgcaacatcttagtggtcttgattacgttggttatcattgttgccttgcgtgcagtcggggttatcttggtaactgccttgcttataacccccgctgccagcgcccgattggtggttaagcgattccaaccaatgatttggctatcatcattcttcggtttgattagcgcctttgtcgggttgttcctcagttacacctttgactggccttccggtccagcaattgttgtcactggtgcggttatttttattatttcgtttttgattcacttggttacgcgtcgtcgcatgcatgaccaagctactaaataggagttttattatgaagcgagttattgggattattgttgctatcgctgttattgctggtgttgtctttgggttgacgcaccgcaattcagcttctgatggtcgttcaagcgacggtcgtttgaatgtggtttcttcattttcaattattaacgaaatcagccaagaagttggtggtaagtacgttaatgcccacaccatcacagcaattggtgctgatcaacacgattacgatcctacgcctactgacgttaagcgtacacaagatgcagccgttgtctttgcaaacggtttgaaccttgaaaagggtggctcaggttggtttgataagttgatgaagacgactgacaagcactacggtaagcaaattttcaacgtaactgacggtatcgacaccatcaagttgacgacggctggtgttgctggtcaagataaccctcacgcttggaacggcatcttggaaggtaagacttacgctgctaacatcgctaaggttcttaagaagaaggatccaaagcacaaggcatactacgcaaagcgcgctgcagcatacgaagctaagttgcaaaacctttacgagaagtggaacgctaagttctctaccctacctgctgatgacaaaaagttggtgacgcaagaaggtgccatggcatacttcgcccgcgactttggtttgaagccatacttcatttgggaaattgatacggaatcaaacggtacgccttcacaaatccgtacgctagttgaatcattgcaaggcgaaagggttcctgcaaccttcgttgagcaaggtgagtcagacaagccaatgcaaactgttatttcacaaattgattcacacatcgctggtgaattgtggacggactcagtttcaaagaagtctggtgttgtgccaacctactacgatttgttgaaccacaatgctgagacaatctacaacggattgactggtaacgataagtaaacaattaaacgccttggatatcattttcgacgtccaaggcgtttttatgtgtcgttatagctgacccaaatcaatgcgtaattgtaattcggcttgttgtttcttagtcatcttcttaagaaccaaatcataggaatcatgaattagtttcttgaccccttcatcaggaaattcgtttttatcgacaacaatactattccagtgctgcttgttcatgtggtaacccggaatgatgaatggaaactgttcgcgcaattcggtattgatataaggatcattcttcagcgtgatgacattgtcatgcacaatgccaaacatctttcccatgatatcgaaatagtatgtttcccaatcttcacgccaatacgccttggccccaggcaatgaatttgcatacgcaatggccatctcttggagcggttgtagtttgtcagttttgttcatggagctttcctttcaattaaaaaacggcatccctggtgcaggatgccgtttaagattacgctgtatatttataatagtccaattctgtggaaaaacaactatttacgctcgatggttgtatgttaatttcatgaatttaatgcaaatcatgacgtgtgaccacattatggttcaacaacgtctttaacatatccgctaatttgcccgcttgttgcatctcgcggagctcggctaccaatgcttgatcatgattggttaatgaatcacttaattccaatgattcaagatattcatccgcgactgacagctggtcgttcaacttcttctcaagcagtggcaccatatcttcagcctcaacatacattgtaaacggcgttaccccattctgttgcttggcatttggctgttgcactgagacgtacaaactttgtggtgttaacgcatcatttgattgggcagcaatttggctaatggctacttgcatatcccaggcacgctttatatggtgggccaattgcttatagtgcgtttgctttgaattcgctggttgttcgacttttttagttttaccaaacatcattctttctccaaaaaagagcccacctttgttcggcaagctcttgtctacaaaattaattaattttcgtgtaaatacaaaggtaaatcaattagactatcatctggcatttcatccacgtttgcaaccattgcaatgtgcgccttgtgatccttgaatacaacaggtgcatccccaccgtattcaccgtccaaattaatcataaccttagcattctcatccaatggcttgattgtgacgttttctgacttcacgtaaagcaagtttggattatcgacgtgctttccagtcaatacttcagaaatcaattgcaagatttcagcaaacttcgtcgtcttaacaaccaacaacgtaaacttaccatcatccaattgcgcatccggcacgatttgttcgaaaccaccaactgagttcgtcaatgccaagaagaacattgatgaacgaccttcaaagaccccgttatcgtattcaacacgcaagttcattggtgcgacacgcgtcaacatttcggcacccttaacgacataggccaagtaaccgtacattgacttcaactttgatggcactgaataagtcaattctgacaaagaaccaccagctgcaatgttgataaagtaagtgtcgttagcttgtccaacgtccatttgcgctgccttacccttcaaaatcaccttagcggcttccaaaggatcttcacgtggaatacgcaatgcacgcgcatagtcattcgttgtaccagccggaataatcgccaacattggacgcttctccaatggggcaataccgttcacaacttcgttaattgtaccgtcaccaccggctgcaaccaacaactcaaaaccagcttcggcagcacgacgcgcctcattcaatgcagaatttggttcagcagtcgtcgcaaaagcacttgtttcataaccagccttttcatagacatttaaaatatcaaccaagtcgcgacgaatggcttcgcgaccagacgttggattgtaaatgatacgcgcacgcttcatggtgttctctcctcaagttttcaatatatgtattgcagacaccaagtatatcgatgtctgcataaattaatcttatgttttgtaaacgcagatgtctaggctcttaagcttattgtggcttacgggcgttcaaaccagccatcaacaactcgttaaccacgttagggttggcgttacccttggtttccttcatgatctttccgaccaagaaaccaacagcacggtccttaccgttgtggaagtcgatgattgattgctcattttcatccaaaatgccgtcaataattggcgtcaaaatagctggatctgacaattgcttcaaaccgttagcttcaacgtattcgactgggtcttcaccttgcgtaattgctgcaaagaccttcttagccatcttcgttgagattgtaccgtcatcgatcaacttaatcatgccggccaagtgagctggtgtcaaagcagtctcttccaaatcaacttgcttctcgttcaagaaggcgttaacgtcacccatcaagtagttagctgaacgctttggatcagcaccctcagcaaccgttgcgtcaaagaagttagccatggccaacgtttgcgtcaacacttctgagtcgtacacttccaaaccaagttcatcaacgtaacgggccttacgttcagttgctgattctggcaacttagcacgcacttcttcaacccattcgtccgtgatgtgaactggtgtcaaatctggttctgggaagtaacggtaatcatcagccgtttccttctcacgcatcaaaacagtttcacccgttgcttcatcgaaacgacgtgtttgttgcttgattgtgccaccagccatgtaaatcttagcgtgacgctcttcttcgaacgccaaagccttacgaacatagttgaatgagttcaagttcttcaactcgaccttagttccgtattccttagaaccaactgggcgaattgagatgttggcgtcaacacgcattgaaccttcttgcatcttaacgtctgaaatacccgtaaattggatagcttggcgcaaagcttcaaggtatgcgtaggcctcatctggtgatgaaatgtcaggtgcaccaacgatttcgatcaatggcgttccttgacggttcaagtcaacgtatgagtaaccatccgtcccgtgggtgttcttaccagcgtcttcttcgacgtgaagttcagtaataccgacacgcttcttctcaccctcaaactcgatttccaaccaaccgttacggccaattggctcttgttgttgcgtgatttggtaagcctttggattatctgggtagaagtagttcttacgatcccagtgcaagtcacgcgttacatcagcattcaaagccaaagcggccatcataccgtattccaacgcacccttgtttgcttgtggcaaaacaccagggtaaccccagtcaataacgttcgtgttggcgttaggctcagcaccgtattgaactggtgaaggtgacattgcctttgagttggtcttcaactcaacgtggacttcaagtccgattgtcgtttcaaagttaggcacagccattacttgttacctcctggtacttgttcaaacaaacgcgttgcttgctcgtatgcgtatgcagcacggtaaatcgtctcttcttggaaacggtttgcgataaattgcataccaactggcaaaccatcaacaaagccggcaggtactgacatacctggcaaaccagccatgttaactggaatcgtcaatacgtcgttcatgtaagtgacttctggatcatcttcgttagcaccgaagttgtaagcaacgtttggtgttgttggggcgatgatcaaatcgtacttagcgaagacattttggaagtcctcgttcatcaatgtacgaacttgagcagccttcttaaagaatgcatcgtaagttccagctgacaatgagtacgttcccaacatgatacgacgcttaacttcgtcaccgaagccttgtgaacgtgtttgaacgtacaagtcgtccaagttcttcacaccttcaggacggaagccgtaacgaataccatcgaaacgttgcaagtttgatgaagcttcggcagaacccaagatgtagtatgctgcaacaccgtacttcgtgtgtggcaatgatacttcttcgacttcagcacccaactcttcaagcttggcaataccagccttgattgttgccttaacatcttcgttgattccggcaccaaagtattcagctggcaccgcaatcttcatgcccttgatgtcgccgttcaagttagcagcaaaatcaggtactacttggtctgaagacgtttggtccttctcgtcttgtccagccatagctgacaaaacgcgggcgttgtccttaaccgtgcgcgtgaagacaccaacttggtccagtgatgacgcaaaggcgataacaccccaacgtgatacacgaccatacgttggcttcataccaacaataccgttgaaggcagctggttgacggattgaaccacccgtgtcagttcccaaagcgaatggtacttgaccagctgcaacagcaacggcagatccacctgatgaaccaccaggaaccttcgtttggtcccaagcgttcttcgtcttcttgtagtatgacgtttcagtcgttgatcccatggcaaattcgtccatgttcaacttaccaacgccaactgcgccgttgtcacgcaacttttcaacaaccgttgcgtcataaattggcttgaagttttgcaaaatctttgaggcagccgtcgtcgtgacacccttcgttaccaagttatccttgataccgtatgggatacctgacaagatgttgtctgggtcgataccagcttcatcaattgcagcagcttctgccaaagcttcgtccttcatcaccgtgatgaaagcttcatacgtgtcgtctgtggcagcaatgttatccaacgttgcttgtgccaattcaacggccgtaatttccttgttaacgagttgctcgtgcaaggtttccaaatctgtgtgcaagaaatccattagccctctgctccttcatcaagaatagctggcaccttaatcaaggtatccgtgtgttctggtgcatttgccaacaattctgctgattggtgcgcgttaaccgcaacgtcatcgcgcaaaactgtgtgcatttctgtcactgaatacgttggctttacgccctccgtatcaacttcagccaaagtcgtcaccacttcgaaaatcttctccaagtggtctgtaaacatgtcggcttcagcgtccgtcaaagtcaactttgccaagttggcaacgtgttcaacttcttcacgtgtaatttgctcgtttgccatgtgcattcctttcaagctgtaataggtttattttaccaaaaaaccgcactattagtacatatcgtcagataattcttctgctttatcttcacgaaccaagaagcgcaatccctttggatagaaattcttcatttggccatcaaccaacttaccaaaaccagttccattaccaccgatttcaagcaagtaccaaccgttctgatattggtcgcggtcacgaatcatgaacgtatcgccgtgaacgtattgcgcccactcttcgtcggtcaattcgtaacgacgcgtaaattggtctgggtgaagtgccaacgctaaggccaaacttggctcgaagcgtttcttcttcaaagttcccaagtgaactccaacacgcatcacttgaagtcccgtcaaatcaggcgttccttctggcgctgcgtagatttggtcaccaaaggcaatcaacaattctggatcgtactccggcatgaagtctgcacggaatgcttgccacaattcgcgttggtccttggtcaagttagacttagccaacttaggttccttagaaacgtaatcttcatccgtttgatttgaaatcaacttggccataaagtgcccttcaccatctgagtgatgtgggaacaaacgcgccgtcttcttcaaatcagggttaccatcggcccattctggctttccatcgtccataccttcgtacttgtcggcatcaacaatttccaagtcagggcgctcgttaatcaaccaagcaatgatacgttcatcttcttctggtgcgaacgtgcaagttgagtaaaccaattggccacccggcttcaacatcttaacggcttcttccaaaatttcacgttggcgcgcagcgttctcttctgggtagtgctcgtgccagtacttgattgcagctgggtccttacggaacataccttcaccagaacatggtgcgtccaacacaatcttgtcgaagtattgtgggaactttggcgacaactcttgcggtgagtgattcgtcacaatagcattttggataccaaaacgctccacgttttcactcaaaattgccgcacgcttacggaagatttcatttgagaccaacagtcccttttgttccataaatgatgccaagtgcgtggtctttccaccaggtgcagcggccaaatctagcacgcgctcgcctggcttagggtgtgcaagttcaccaaccaattgggctgatggctcttgtgagtaaatgacacctgttgtgtgatcaacagagtgaccctttacggcaccgaaatttccccacttaccccatggcaccttgccatcggccttggtatcgtataaatccatgttggccttcaaggggttttgacggaacgccttcacgacaggcttatcgaacgattcaataaaagcatctgcctcatcgccaagtaattgacggtatttttcttcaaatccttctggtaactccgccattcggtatctccttaaatctaagtattcttatttattttacacgtttttcacctattttaaaaacctgacctgttgcggtttggggtggtaattattatgtgaacttcgagacacgaaaaaagcgtccaccgcgtaagcagtagacgccccattatccaaacctaggaacctgtcggtctagcgaagctgccacttcgttaggctttttctatgtctaaattataacatagtcccttgcatcgtggaactttacttcaataattacaatgacaacttcaacagcttctcaagataacgagccaagccgtcttcttcgttagtgtattctgtcatatcgtcggcaatcgcctttagttcagggttcccgttcttcatcacaacaccgtgagttgcgtagccgatcatctcgaagtcattcatctcatccccaaaggcatagatatcatctttcttaatgtcgtaagccttacgcaagatgtccaaaccagtatcctttgaaacaccagctggtgccacttcaagaactggtgattcaccaccccacgtcttaacattcacgcggtcagcaccgtagcgctcggtcacgaagtgttgaatctgtgattggtgcaaggcattttcggcgtgaattaagatagcattcacatccgtttgcaagttcaaacgatccaacatcttacggttcgcttcgtcttgtgggaagaaaatcgcatcttccgtattacgttgtgggccattaccatttgcccacacgtcatttttgctttccgcaacaacggtatcaatacccatcatttgcgcattttcaagcaggtcaaacgcaatttcacgatcaatattaaatgaatactcgtgttcccagtgttgacgtggcttatgacccaatgacccgttgaagttaatcattggtgacttcaagcccaacgtgtcgtaaatatccatcgacaaacgtacgggacgccccgtaacgatcgacacaatgtgcccatctgcttgtgcagcttgcaacgtacgacgggtacggtctgaaacctcacctgcgtcattcaatgttgtcttatccaaatcaattccgattagtttgcgttccatgcgttagacccctcttttgactcaattggtactatgttagcacatatctgaatgggcgtaactaaaatacccgtcttcccgcacgttttggatcaagcatggtttgttgtgactgccacgcttgtgcttcagcaatttcctggataagccgatcgccaatttcttgtgaaaaaccgccatcatacagacgacgtaagacatactgcatttcggagttaagtgccttcataatgtgttctttcttcagttccacgcgattcagccctcgtaacaaggatgcatgtctaaatcgataaatatctaaaatgcgttcccacgcatcgtgagctccaacatcctccgcttcatttcgacgttctgttacccaagccatcatgtacgtcgaattttcattcgagatactgcgccattgttgctgtaactcagcaatgttcgctgaccgtttctcttcacgttcttgattcgtcatgccagcgtgaatgccccgttgttgataacgttgaaagacccaatttaattcacgtcgagaaagagtcgctttaagtgatcgccatggtgcaaatgacaattcttcagctagcatcaggtcaatcagatgcaaataggcatgtctgattgccgggtccacagccgttatcgtctgcacatacgtacgtgacgcctttgcggtatcttgcaataaacgattaaataagcgctgattttttgaaaaacggtttggtctcacctgtgaactcaaatattccacgattcccaaatataattcctcgggcagctgcttctgtttgagttctgttttagtggccgcaaacatttccagacgtgcctcttgcaagtcgtcaaccgttacaggcgcttgcttagccggcaaccaaaacggtagaaccagggttggcacaatcaaactcaaaccaatcacaatagcagctgccagtatcaaaccaggccgaaacggtacgttggttggaattgaaaacgccaatgctagcgtcactgccccgtgaacacccgacagcgcaaacgtcaccgcattatgacgtcgctcgctagaaccatccggaccaatcaactcagaccacgtttcttcatgccggtaataagctaacaagccacgcgcgataagcatggcaaaatatgacaaaacagccaatgcagaggaatggagaagttctgattttgtcatgttctttattaaatcaatgacattgaatatattcatccctagcaggacaaaaaccgcattattcaacacacttgatagcacttgccaaagactacgactcgttaggccatcatgcaccaacgacagacgcgttcgcattgtccgttgcacctggaaaattgctgctacaacaaccgccagcacacctgaaacaccaattgactcggcaataaagtatgcaataaatggtgtcattatcatcatcggcacaacggaactcattgaatcactagtctgagaagcaataaaatcaattagcaagtaaatcaggtagcctagcatcataccgaccaagacaccaccacccgcaactttgattaattcccatacgcccgctgtcagtgacaatcgatttgcttcaacaccggtcaacgcaatactcatcagcacaaggcccgttgcatcgttaaacaatgactcgtactccaaggccgtttttgttccttcaggtaccgcaaaattttcggtaattgaattggcagctacggcgtctgttggcgtcacaattgacgcaatcagcaaagacaatggaattgaatgcgccaatcccaccggcacaccaattaacgttgtcaccaacgctgtcaaaatcacgagtgatcctgccaagtaaataattgatcgaagatgtttgctaacgcgatacggattaaaacgctgtgcgtcataatacaaaattggtgcgatgataaacatcatgaaaaactctgactctaatgccacgtgttctctaatatagggaacgaatgacagtgcaaaaccaatcgcaattgttataaatgcttttggcactttcttcagtcgattcgcaacaatactcgctaggataacacccagcaatacagcaaatataatgatgatatccgacattctctcacctcaaaaaagactttccggcacaagtataccaaaaagtcttttttcacataaatttattgttggaaaggcactaataacttgctattgacagtatcaactgtatagcgaatatcttggttaccacgcaccgtcatttcaaaatccgtaccgtacaaaataacacccaatttgtgacccgccttcaaacgataaagcgttggctgcaacgtcaagttaagcgtcacaaactcatcagctaccaaatcatcaacttgccatggcgcagtgcggttttgcaagttcatgtgaccaatactaatcatcttttcagtcgttggtttttgcaacttgaactctaccaatggcgttggttgccattccgtaccgcggtcaatttgttgaccaagtggcgttggcgttgcacctaaacgttgggcttcgccatagtcaaccaacatcgcgctcaccaagccaaagttttcagatgacttgatacgcaactttactgtcacttcaccatcaatcacaacatcgttttcgaatggtgcttcggtgaatactaaacgattgacttcaaagcggtcgttttcttgcttcaacatttcagtacgccagttattaaagtcgcgcttgtaactctcgaaatcagattcaatttgccaatcttcgtagctcatctcatcatccccagccagtggcaaagcaaccgtttcagtttgcccccagctttggcgtgtttcccacgtttcagcttggtcattcgcttgccaagtcacatccggcaattgcgtttcggcttgattcgcaacaccataaagcttgtgtgacaaccacaaattcatttgatctgagaaatcaagcgaacgattgttgttgatgtagatgtgttgtccttgatgcaagtacagcttctttgcaacgccacttgtttgcaatgcttgccacaaacggaatacttggcgtggcttaacgttccaatcattcaagccatgcaccatcaccacgtcagctttaatgtctgaaacatgtggcaaataattgcgcgcatcccaatatgcattgtagttacctgactcacgatccatcatctggtcagtttgggcttggaaagccgtccattgatccttcgtacgatgccagtcagctgcatcgtgcatacgtgaataaactaattccgccaacacatccatgtcttcacctgggaagccaccaggtgcaataaccaaaccgttatcacggtagtattggtaccaatctgaaatagctgcttcagaaatcacggtctctaaacctgccacaccagtagttgcgaccgccgttgccaatgttcccaaatatgactttcccgtcatcgcaaccttgccgtttgaccagttagccttaacggcataacccgaagtccggtctgtgaaggccacgcgattaccggccaaccattcaacaaccgccttcattgaaagcacttgttctggcgaaccagtatcttgcatcccgtctgaatgacgcgtgccgacacctgaagaatacgcaaccgcaaaaccacgtgccaagaagtaattattgatatcaacatgacttgttgccttgaaactttccgttgcttcatcagcttcagcaacaacctcatgttgctcagcatccggtagcgtcacccctgggaatgcaatatcttcatagcgcaccttgtttggtgtcttgtgacttagtggcacatcaaccgtatgcaatttggcatcattcgcctcgttgttcaatccttgatagtaaggtgacgccgtaaataagactggtacatcaactgacgtatcaggtcgcacaatttcaacccgaaccaaatcacgaacaccgtcttcatccgtatccacatctgtttcgacatacacgacttctttaattagcgcacttgtatcaaaagtcgccattgctttcccgttgaaaaacagtggcaaattcgtcttagcaaagtaaccacggctggccaaatcatcgataaattgcaacccgccggctgtatgcgttgtcaacaaagcataccaagccgtaagaacatcatccacgtcccacttgccacgcttttcgtatagcggtagtccaaattcatgaactgcttgcagtggttgatcaatttggtaatcaacagtttccgtgaagccaagcaactgcaatgcaactgcgtcaaaaatctcagttgttagtggcgccccactttgcaaaaatgtcgcaacatcacgattgttatcaacagctaattcacgcaattttggtgttgcgtcacgatattccggaaaggcttggaccaacaaagcctgccaaacggctgccgccccagcacccatcgcgtcggtcactgactcgtcataaaagccaatttccgtcagttcgtgtacttgttgttcgaacggagtctcaaccaccgcatattgatttatcttcattaatttggacccccagtttgttaggttcattataccaaaaatgagatttttatgagatagcaaaaaagccggatgttaaatccgacttcgttgtgattaattttcaattgagatgacaccgttggtcgtttgaatcttcgaagccttcgttgcatccccagtttggtaactcttgtcatcgtcaccgttttgcacatcttcaacgtgcacataaccattgtgggttgatgcatccaaacctgggaaatggctatcctcaagcttgatcataccgttcgttgatgtgatgtcactagcatccgtcaatgtcaaattctcagccttgaatgcgctgttttgactctttgaatgcacggcatgcaagttcgtatcttcaagtgcaatcgcaccattcgtcgtcgtgatgtttagttgctcaccttgcaagttttcaaagcggacaccaccgtttgagttgcttaccgtcgtgttcttaacgttttgaccttgaacaatcatgccaccattcgttgtcgtaatctttaggttgtccagattagccgagaatggcaccgtaactgtaacctttggatcatagttgccgaaagagaaaatcagtttgtgattgtcatctggtgcatcaatacgaagcgtcttatcttgtaaatcagtcaacaccttgtttgacgtaccagtcgccgtaacgccccagtctgtaccgcggacgatttcaacgaggttgttaccagcatcaacttcaaggttttgcacttgggcatccttgaacgtcttgtgcgtcgtagaaacgtcaacaatcttaggtcccttgtcccaagcgatgttcgtttcagcaccggcactcaagccacccacaatcatcacgccaccaagcaccataccagcagcgccaataatcaaagttttcttcaaatccatgcgcttacacctcctgtgcaggttcaacatgattcttgcgaaccagcttgcgaccaatccactttgcaaagacaattacttgttcaaacaaccacttcgtcacgcgccaaactagtggtgcgaagaaaatcgtggctgccgttgcgacaatcccggctcccatgaagaagataccggttgcaactgattggaatagcaagataatacctgaaacaaatgaaaagacacccactgccaatgctgcaataattgttgcataaatcacaaagatgaccccgataaaggccataaacacaccaaacaaagcagcgattagtatcaatgcaactggaatcaaaaccggtgaggcgaacaacccaagaatgatcaaccaaatcaacgttgcgcggttctttgttcgcttaccagctggcatatcagtcgcctccggtgcatcatccacttgaatgaagtactccaacttcaacttgcgggcaaattcctttggcttgccatacttctcaacgatttgctcggacgttaacccagcgtccatcatttgttcctcataaaactgtagcagttcttcgcgttcgttttctggcaacccagccatataacttctcacgtctgctaaatactcattaaccattattgttcctccaatagtgagtcaactgcgccacgaaaagcgccccagctatcttttatttctgtcaaatgcgcttgcccgtcagcggtcattttgtaataacgtcgaatgcgaccttcgaatggttggtcgtacgtttcaacataaccatctttcttcaggcggcgtagcaccggatacatcgtcgactcactgacgttcagcaagtcttgcatggttttcgtgatgatatagccgtaggtatcttccttggctagaatcgcgagaaccgaaccgtccaatacggtcgtcggtacttgaatattcatacccgtctccttcgtgtgatataacactatttacgatatagtatatattatacgagatataatgatatgtcaaacataaacacttgagacaaaaaaagacttcacagcaagcgctgcaaagtcttgataaatatctattagaacatgttgcgaaccgtttcaacgatcaattggatgttcaatccagtcaaaacgataaacactagccaagcaatcgttgtcatccacttaggattaacgaagtcttcacccatcaccttctttgatgatgtgaacagaatcaatggcgccatcgcaaatggcaaggcaattgataggaagacttgtgagttaatcaataggacgtccaactttgactcgtcaccaccataaatcaacgtaaaggcgataactggggccaaagccaatccacgtgtaatcacacgacgcgcccacattggaatcttcaaacgcaagaatccagccatgacaacttcaccagtcaacgttcccgtaatcgttgagttttgacctgaagccaacaacgcaacggcgaacaacgttgacaagattggtgacgcaattgcaccagcaaccttgctatctgacaaagctgagtacatttgaccaaacgttccaactgaatcagcatgaccgaagaacaatgatgctcccaaaatcaacaacattgagttaacaacgaaggccaacgtcaattgaatgtttgaatcccaagtcatgaagcgaacagcttccttcaattcagccttgttctcacggttaatcttacgtgtttgtgaaactgatgagtgcaagtacaaattgtgcggcataaccgtcgcaccaacgatacccaacgtcatcaacaatggtgaatcaacaccctttggcgcgtgcgtgcttacagcttgcaattgtggcacgtaaccacccaacatcgcaacgatgtctgggtttgatgagataaccaagtaaccgaagataaccaaaatagtcaaaatcaatgtaataacaattgcttcaatcttacggaaaccgaaacgcatcaacaacaatagcaagaacacgtcaaacgctgtcgtcaaaacagacgcaatcattgaccagccgaacagcaagtgcaacgcaatcgctcctccgataacttcggcaatatcagtggcaatcaaagccaactcagtgataatccaaagaacgaaaccacccgacttactcgtacgagcacgtgtggcttgggccaagtcttcgcgcttaaccattcccaacttaccagccatgtattgcaacatcatcgcgatcaatgatgacaccaatacgactgacaaaagcgtgtagtgataattcgcaccacccgcaacagacgttacccaattacctggatccatataacccacggcaaccaaggccccaggacctgaaaaggcccacaatttacgccagaatgaaccgttctttggtacctccacagaaccattcacatcacccaaacttgcatcagcagttgcatcgccgacgaagcctggcttctttgtcatttcttcagacatgacaaaccctcctactatgtttttagaaactcatagcgaggttttccccagtgtactattaacttttgatattagttcatagtgctaaataaaattcataaaggatttcgtccaatcgcttccgattgaaggcttatgactttcacttaaccggggctcctcacccgcaagagttagtatacagggtgaatgttttttaagcaatagtattttttcacacaagtcaaaaattattcatacgtatgatgttttttaggttttcactttctaaaaacaagaaaagcacatgttgccatgtgcttttcattagtcgacgaaccagtccatcagatagtcgtcaacaaaatgaccatctaaataaaattcgtctttcaattcaccaactttcttaaagccagctcgttcatacaaacgcattgctttagggtttgtccccaatacgcgtaaggttattttgtgcattttctcttggcgagccaattcttgtagccacgctaacaattggccaccaacaccttgaccctgggcggccggcgcaacaccaaggccgatgtcccacttataatgatgacttggaaaacgtgacgaaaattcaacgtatcccaatacagcatcattctcgtccactgcaacgccatgacggcgtccttcagcaaccatcgcggctttaaattcaccggcatccggccatttttgcatggcaacgggtgcatttgtatcgttccaaacaacctcatcgattgccaaaataccagcataatctgccaatgtctgtgcttctctaatttccattctgacttacccccaaattaaaaccccataccaacgtggcacagggcttcatatctattacttcttaggctcttccaaatcgcaacgagcgatcattgatgataccttggcgtgacgcgcaacgtaaacggcttgagaacccaatgattcccaccagcccttctttgagtgcgccccaacgataatcatgtcagcgttaacgcgtggtgcgatttcttcaaccaacacttcaccggcacgttgaccgctatcaaagacaacttcaacatcctttacgccgtgcgcttctgcatattccttgtaacgcgccaagttggcttccaattggtcttcaaccgcttgaacagttggcaagctcaatacatcaaccgctgacaactcccccaactccaaaattgatgcgatgatcaactttgcatcgtcctcaacagcttggtgaatcgcattcgccaaagccacgtgaccttgttgtgattcatccacacctaccaaaatacgttgaaaatgcattggttcaatttccaaattcaattcagctaccatgttaatatcccccatatctatatgatgaggcaagtatatcaaactagcggtattttttcagtgcttaacctgcgaaaaatattagaattttctaatcgacaatttcagtcgtctcaccgtcacggaacgtgattgccaaaccacccagcaacttacgcataaattgatcaccggcaaccaagtacttggggtggcccttacgacgcaacatcgccccaacttcaccctttgacaccttaaatccagctgcttcccagaactcaatcaagtcttcattgctgtaagtcatcgcaatcttcaacttcttaatcacgacattgttaatgtcattatcacgttgcatgctgtagtcaggttcaactggttggccatcttcatccttcttcacaccacgttgtgaaataatcaaaccgttcatgaacttctccaaatcgcgacgtgacaacttttcatcacgaggtgtatctggttcttgcttcgtcataatatcttggtattgctccttggtaatcgtcaaaccaccaagttcaaaaatcttaatcatgtcagcattcttaatgttgtagataaaacgaatgcgacgcacgacgtcattattattcattgttgttctcctgttaaaaaacgccggacaagcgtccgacgtttgcgttcattctttattatgcacgtgaagcgttaacttggtccaacgttgggattgatggttgtgcaccagccccttgcaccgtaattgcggcagctgcattggcaaagcgcacggcttcttcaacgttacgcatatcggcgtccaacttagtcgtcaacgcaccaataaacgtatcaccagcggccgtcgtatcaactgccttcaccttcaaagctggcacgaaaccattttcgccatcagccatgtagaagtaagaaccgcgctcaccaactgtgatgataacgttcttggcacccattccttgcaaacgcttggcagcactttccattgataggtcatccgtcactggaatgcccgtaatgatttcagcttctgtttcgtttggtaccaccaaatcagtcaccgcaaacaattcggctggaatatccttcgttgctggcgctggattaagaaccgtcatcacgtcagcttccttagcgctcttaaaggcgttcaacgtagcaaccattggcgtttcaaattgtgcaatcaacacatctgatgccttgatggtatcctcagcaacttcaacgtttgattcgttaacttggcggttggcaccacccaaaatcaaaattgtgttgtgtgagtcagcttccaacatgatgtaagccgcaccagttgcgacaccttcaagttcagcaacgtgggttgtatcaacaccatccgccttaagtgcatccaaaagcaattgcccatttgcatcttggccaacggcaccgataaagttgacatccccacccatacgctttgcagcaacggcttggttagcacccttaccaccaggggcagttgaggcgtcatccatcgccatcgtctcgccttgttgtggcaaatgtggaatgtgcagaattgtgtcagcgttcaatgaacccaaaactgtaatcttcttcatgttgttcgctcccttactacttatcaacttagtataacagaaaaagtgccccaccacccgcttggataatgaggcactttcaattagttgttgttcaaaatttgatcgatcgttgccaactcttcagctgacaaatccatgttatcgcgaaccttcacgttgtccaacaagtggtcaactgatgaagcaccaatcacgattgatgggacacggcggtcacgaagcaaccaagccatagccaattgcgccaacgtttgaccgcggtctgcagccaccttgttcaacgcgttcaacttcgcaaccgtaccttcaggatcttccttaatgaaagcattcgtacggtgcaaaggcatgtcagctgggaaaccatctaggtagcggtccgtcaacagtccttcagccaaaggaccgtaggcaatcaaaccggcgtggtgcttgtccaattcggccaacatatccgtcgtttccgcttcccggttaaacatgttgtatgacatttggttaccaataaatggcgtgtgcaattcatcgaagattgccccaatttcagcaacttgttccgtcgtgtagtttgaaacaccaacgtacaaagccttaccttggcgaaccatcaagtccaatgcttcagccgtttcacgcaagtttgtgtttggatcccaacggtgtgcatagaaaatgtcaacgtaatccaagtgcatacgttgcaatgacatatccaatgcggccgtcaacgtcttcttaccagaaaactcccctagtggacctggccacatgtggtaaccagcctttgtcgtaataaccaattcattacggtatggcttcaagtccttctcaaatacagcaccaaatgtctcttcggcagagccatctgatggaccgtagtttgatgcgttgtcgaatgagaaaataccattatcaaacgccttcaacatcacttcgcgtgagtttgcaagtggcttttggtcgcccaagttacgccatagtccgaaagacaatgctggcaaaatcaaaccagaatcggccacgcgacggtatggcatcatatcataacgattatctgcagctgcataaaccatgtgattacccctcaagttaattaaaattcatataccttagttaacattataacttagcttctggattattgcgtgacttcaacaaaacatccaaagcgcgattatcgtgaatgcgttgaatagcttcagctaacaacggcgccactgataacatcgtgaacttagcactttgcttttcagctggtagcgtcaatgtgtccgtaaagaccagacgagagatgttatcatcagccgccaaacgttgggcagcatcaccagacaaaacggcgtgtgttgcgacaacaaagacatcggttgccccatttgcacgcaaagcacgcgctgtcatttggacacggcgaccagtatcgacaatgtcgtcaacgataattgcgcgacgaccagccacttcaccaacaatggcatcaggtgactcaggtgttgtcatagccacgtggtcatttaccacaccccatggtgagtgcaacaagtcagcaaacttacgggcacggccagcaccagtgtgatcaggtgacacaaccaccaaatcatccgtcatgttgcgactgtagaagtaatctgacaacaatggtgcagcttgcaagtggtcaactgggatatcaaagaatccttgcaattggtcagcgtgcaaatcgatggcaaccacgcggtcaacaccattcatttcaagcattgaagcaaccatcttagctgtgattggttcacgtgactttgccttacggtcttggcgggcataacccaaatatggaatcaccacattgatttgcccagccgaagcacgacgcaatgcatcaatcacaatcataatttccatgaaagcgtcgttcacttcttcagcgattggtgccacgatgtaaacatcatcgccacgaacgctttccaaaactcgctcataaatttcaccatcagcaaaacgttgaatgtcaatttgactcaacggttggtgcaactcttcggccactgcacgcgccaacttactgttagctgacagaccgaataacttaatttcacactccacgaacgaattcctccatttttttgcggtagcttaaaaagctactttacggttacttctattctaccaaatatcagtgataaattcgcctggtaactgtatttgagaattaattcacgagtaaaacgttatacccgaaaaacagtgtagtcataggccttgaaacctggtagacttaaaaaaatttaatttcacaagaagacttttgggggacaaaaagccatgacaactttgactgcgagcattgctggttttgattttgacaacgtattattgaacgctgccggcgtatattgccaaacggcgtctgaattggaccaaattctagaggccagtggcgctggttcattggttacgaagagtgccacacctgccgaacgagacggtaacgctggggtccgttttgctgaaatgccattgggttcaatcaactcaatgggcttgccaaatcttggcttggattactacttggactacacaattacacaccaagacgaaaagccattgttcctttcaatcgctggtctgacaaaggctgacaacttggcgatgttgcgtgacgtgcaagcttctgactttaacggcttggtcgaattgaacttgtcttgcccaaacgtgccaggtaagccacaaacggcctacgacttcgacacaacgcgcgagattttgactgaggtcttcagcttctacacaaagcctttgggtgtgaagttgccaccttacttcgacatcgcccacttcgacatgatcgctgaaatcttgaacgacttcccattggcctttgtgaacacgattaactcaatcggtaacggtttggttgttgatcctgaaacggacacagttgtcatcgcacctaagggtggtttcggtggccttggtggtgaaatcgttaagccaacggcccttgcgaacgtacgtgccttgcgtcaacgtttgcgccctgaaatcaagattatcggcactggtggtgtgacaaacggtcgtgatgtttacgaccacatcctttgcggtgctgacttggtctcagttgggacgtcactttacttcgaaggtcccgctatctttgaacgtttgaacaacgaattgatcgccattatggctgaaaaaggttacaaccacctcgacgaattccgcggacagttgcaaaccctcgcctaaccccctatacttgtgttaacgaatcaaacaagctggggtgccgttatggctgagataatacccatggaacctaagcagggtaatgcctgccggggagcttggtttgtttacgattgaagtaaacggaccccagtatcagactgcgtgttgcagtgatgctgaggtcctttttatttccatggctttgggcgattcggaatattatttggaggtttgcgtcatgcaaacagttgttgaaaacaagcgcggttgggcgcttcgagatgttattttcctagccattattgcaattttctttggggttatctaccaattatggggtgcctcatactacttcttgtcagcgacgccacttaagccatacgccaacgatatgacgattggtgtttggctgatggctggtccattggctggtgtcttgttgcaaaagtttggtgccacgacaatcggtgaagttttggccgctgtcgttgagatgttgctcttctcaagctggggagccgcgacgttgatttacggtttcgtccaaggaatcggttcagaactcggttttgccatcactggttacaagaactggagcaagcttggtttgagcctatcagttttgacgagcacgattgtgacatttgcttgggacatggttaactcaggttacatggcctacaagcccggcatgttgatcacgttgttcgtgattcgtttgatctctgttgggttgtttgccggtgtgttggtctacttgattaacgccttggttgcgaagtcaggtttgatgaagcgttaattatgacatcattacgtgttgtagatttcagctttgcttacgaagctgatcagccaaacattttgaataagataaatttggatttgacacccggcagttttaacttgatggtcggcccttccggctcaggtaagtctacgttgctcaaagcgatggctggcttacttccaaaatttggtgtcgtcacgaatggcgacgttctcttggaaggtcaatcaatcgggccaatcgcaccatttgagaaagccaagcgggttgcgatgctgtttcaaaacccggaccgccaatttgcgatgcgcactgcccgtgagcaaatcacgtttgcattggaaaacttgcaattacctgtcgccgacatcgagcgtcgtgtcacagatgcgattacgcgattggacttggctgcattagccgagcaagaactaataacgctgtctggtggtgaaaagcaacgcgtggccttggcgacaattttcgcgatgcaaagtgacatcattttgcttgatgaaccattcgccaacgtcgatccagatgcccgccaattgttgttgcaagatctcaaagatttacaacaaacaaacggcacgacgattctgatttccgaccacgacttgtctgggtacgccgacctggttgataccctttaccaactcgacacgcaaactggtacgttgcacgaagcaagccgttatatgctaactgacattgcacctgccccaacctttggtggcacaccagttggtgatggaccattgcgctggcaagactttggtgtagcagttggtgaccgccaattgttacacgacgcaacctttaccgcacccgctggtcagattgggctgatttcaggggctaatggtattggtaagtcaacatttttcaagggactcacccatcaacgcgcgtatgatggacaaattctttgggaaaacgtcgatggtcgtaaagttaaacaaaaacactggtcacaacggcttgcgctggtcttccaatcagctattgatcaattcgtgacaatgaccgttgcgagtgaaattgcgctgtcgaaaaagtttagtttgcaagcaaattactggacggatgaccgtgttgcagctgcgcttgagaagttacaattaagcgacttacaagaccatgtcgtgtaccaactatctggtgggcaacaaaagaagttgcaactgctgacgatgttaatcatgggacaaccggttttgttgcttgatgaaccgctcgctggtttggatagtgcgtcggtcaatgtattgatgactttgttgcaagaaacgattcagcaaaccaatcaaaccgttttgatgatttcgcatcaacgccaaggtttgacgggctttgtcgattatgaattgcatttcgccgaccaacagctaacgctaatcggaggtacccaacatgtttaagttgaatccgaccgtttttctcgttattttaatcgggattggttttcaaaccgcctttagtcaatcaattacgttgaacatcatcgttgctgtggttggtttgctatatctattattgcaacgtgtttccggtaaagttatcgtgattatgttgttggtggctgccccacttgccttcggaacgtggtggtcattcattgcgtttggaactggtgatacgcatcgcattgcgttggtttatgcctcacgtctctacgcctatctactgcttggcgcagcgttgaccttaaccacgcacgtgaaagatttgctcatcagtttgcacttgcatgccaagttgtcatcaacgtttacctatggtttgttggcagctttcaacttgttgcctcgtgtccgacgccaagtccaaacgattcgttacgccgcctcattgcgtggcatcacctatcacttttggagtccacaattgtatttcaaagcaattgtgagcgccctgcactggtctgatgacttggctatggcgatgacatcacatggcttcacggaaagctttccacgaacacaaactgcgactgatcctttaccaatctggcattgggctgttgccatcatcttgattgtcggctatgccattgtggcatggattataaaaccttattaacacaaaacgtgcccagcaggttcatagtagcctgctgggcacgttttttatttttacagatgattatttttgagaatgtgaggttattaaaattacttgttgaaagtcgtacccaaaactgagtagatgtagttgttcaaggttgccttgatagcttccaaacgaccagattgaattgttgcaaatatttcgtcgtttgtcttgttcaagatgtagtcttcaaagtccttgaaggttaccttatcagcttcaaagtcggcaccgatacctgaatcgaatgatgagtagcgctccttgtaaatattctccaagaagttatcctcgaccatcttcaacgcaacacgcaaaccagcggcgtaaacatccataccggccatgtgggcatagaacaagtcatcaggcttgaatgatgcacggcgaacctttgagtcgaagttcaaaccaccagttggcaaaccaccgttcttgacgaactcatacataaccaacgttgcttcataaatgtcattagggaattcatcgatatcccaaccagtttgcttgtcacccatgttggcatccaatgatcccaacaagccagcttcacgggcgaaacgagcttcgtgttcgtaagtgtgaccggccaagtatgcgtggttaccttccaagttcaacttgaagtcgttttccaaaccgtacgtcttcaagaaggcaatcgtcgtttgcacatcagtatcgtattggtgtgccgttggctcctttggctttggctccaacaagaattgaccagtgtagccaatttcgttagcgtaatccttggccaacttgaagaacttggcgatgtgatccaactcacgcttcgtatccgtgttcaacaatgactcgtaaccttcgcggccaccccagaagacgtatgactctgaacccaaacgcttagcaatctccaatgagtgcttgatttgggcagcagcataagcaaagacatcagcaaatggtgtcgtggcaccaccggccaagaaacgcttgtttgtgaacaatgatgatgtgttccatagcaacttcttgccagtttcgtgcatcttttgctcaatcttgtcgacaaccttatccaagttggcgttcgtctcagccaacgtgtttccttctggtgccaagtcacggtcgtggaaggcgaagtattcaacgcccaacttgtccatgaactcaaacatgtaatcaaccttcttcaaggcttgttccatgcttgtgacatcatcaacaccgtcaacatcccaaggacgtacggcagttccttcaccaaatgggtcaaccaatcgttggtccattgtgtgccagtaagcaactgagaacttcaaccaatccttcattggcttcgtttctccgttgatagttacaggctcctcagggttatagaagttatatcccttggcgtccaaaaagttaatccccttctttccgccaaggtactcaaccttagggaagtcaaacaattctgacatgatgctatcctccaaaattagaacaaaatctgtgttggcagctaaaacttcgtcagcttagttgggttgatttgtcctgccaaccaacttacaacacccattataggagcctaattttcaaatgcaagccctttcattgttcaaaagactggttattttgaaacgccacaaataactgatggttaaatagttctagtctgaaaacttgtacacaaaaaaatagtgctgaacgttttgccgttcagcactataaggtttattcaaaatgtgcttttaattgtgtcacgcttggttgacccggtgctgatgactcaccgagactggcgaatgttaattgggaaccatattggtacccttcaaaacgcgaccgctgaccaagttcacccatcgccattgtgattaatggctttgcttgattggctactttagttgcatccaacaatcgttgtacatcaccagaatcatttggcatcacagctagtttcacaacatcaaccggtgttgcaaccatgctttgtaattcagcatctaaatcagctggcgttgcgttgaaataatgacgagagccaattacagtaataccttgtgattgcgcatcttcgaccacatccccaacttcttcgagcagtgaaacttcgacatccaccgccgcaacgcgacttgcaatcgctaactgatatacccagtgataagcgatgctatcaaagtcttcttgtccaccttcagctgttgttcgccacgtgacaattaacggtttatccgcattaaacgcaatagtttgcatttgacttgcctgcaattcacccggatcagttaaataatccacgcgccattcgatgacatcagtttggctctcattggcctgttccagcatcaccagcacatcattcacggtttcacccatgactggtactgctattaagggacgctcaggcgttgcaactgctgacccaattttcaaattcgtcatcttattcacctagtaaatcgcgaatttcatttgcgacttcagctactgttttattatctgttgcgatgacatgacttgcagcggcatcatatttcggcaagcggctacgccaaagtgccgccacctccatcaaggtctttgaacgcaaaataggtcgcgtatcatcatccgccaaacgttccattgtttgtccaaatgaacctgatagataaaacactggtacattcgcttcagacaacaattgaatattacctggcgtctcgataatgcccccaccagttgcaataatgccctcattattaataacttcttgcaacacatcatgctccagtgcgcgaaaggctggctcaccctctgttgcaaagatttcacctagtgtttgtcccgtcttgcgaataatcattttatcggtatcggttaatggcacggccagcatctcagctagcaagcgaccaaccgtcgtcttaccggcccccatgaaaccaatcaaaatcgctgttttcattatgcttccaccaatctttctaggtccgtaaagaagcttggatatgacacactgactgaatcggcgttcgccaaggtaacttcaccgtccgtcaacaaagcagcaatcgccagcatcataccaatgcggtgatcacctgatgaatcgaccaccgttggctcctcaacatgcaacggtgtgccaccatgtaccaagaagccatcttcgcgcgcttcaatattcgcccccagcttattgagttgcgtggtcacggttgcaatgcggtccgtttccttcacgtgcagttcttgcgccccggtaatcaaagtgtcaccaagcgcttgggtcgcggccaacaccaacatcggaatttcatcgaccgccgtcggaatatcttcagacgtgatagccgttccttgaagggcttgcgtgcggacaatcaaatccgccgttggttcaccttctgcaatcacattatccagttcgatcacggcacccattcgacgcaacaaacgcaaaatgccatcacgggttggattaatcccaacaccagtcaaacgcaattcactatttggcaccaacaacgcggccacaatccaaaacgcagctgatgaaatatcgccaggcacgttaatggtcgtcccagtcaaagccgtatttggtgtcacgataatatcttgaccatcacgaacaacatccaccccgaaatggtgaagcatgcgttcagtgtgatcacgcgttgcaagtggctcggtaatcaccgtttcaccttcagcctgcaatccggccaaaatcaacgcactcttcacttgcgcagatgccactggcaaacggtagtgaatcccatgcaagccaaaaccaggcatcgtcgtgactggcaagcgatgattagtggacacaaaacgagcccccattttagtcaacggatcaatcacgcgcgccaacggacgggtactcaaactggcatcccccacaaacgtcattggaaatgattggttcgctaacaagcccatcaataagcgggtgcttgtcccagaattgcccatatcaagcggaccatctggctccgttaacgttgtgagtggccggccgtgcacaacgacacggtcatcataccagtcgacggttactcccaactgttgcatggcgcccaatgtattgcggacatcatccgaatcgagcaatccataaatcgtcgtctccccagttgcaatactccccaacataaccgcacggtgtgaaatactcttgtcccccggtaccgttaactggccattaatgccggttgctgcagtttttaattgtcggtttgtcataattactcctttcggggcgacttagaagtttttaatttcggcacggtatgccgctaattgctccttcaaacgatccatattatctgtatcaaatttatccaaaatggcagtcgccaactcaatggcaaccatgtgctcggcaatcacggctgctgctgtaactgccgttgtatcagagcgttccactgaggcacgatgattctcgtgggtatcgatatcgacactttgcattggacggtaaagcgttggaattggcttcacaacaccctttacgaccactggttcaccgttggtcatgccaccttcgaacccaccaaggttgttagaaccacggtagaaaccgcgttcctcactccagtagatttcgtccatcacttctgaaccaaacttttcggcattctcaaaaccgccaccaaattcaacacccttgaatgcgttgatgccaataatggcgcgcgcaatcttggcatccaactttgtgtcagccgaaacgtatgagcccaagccaaccggcacaccagttgcaattacttgcaccgtaccaccaaccgtgttgtaatcacgctttgtatcatccaacaacgtgcgcatcttctcatccgtttcagcatccaacgtacgcgttgggaaactctccgtaacagcgcgcaactcagccaacgtcttatactgggcgatttgccccgcatcagcgcgcactggcccgatgttcaagacgaatccgtgcacatcaatgcctaattcagccagcaaacgcttcgcaacggcgccgacggcaacacgcatcaccgtttcacgggctgatgaacgctccagcacatttcgcaaatcggccgagtgacgatacttcatccccccgaccaaatcagcgtgaccgggacgtggacgcatcaccttacgcttgctgttttcttcgtcagctggcgtatttgggtccattattttcgtccagtgattgtggtcatcattgtgtacattcaacgcaattggtgagcccaacgttacttgatgacgcaccccacccatgatggtgaccgtatctgtctcaatcacttggcgttgcccgcgaccagcggcatgctggcggcgcgctaattccgtattaatatcttcttgggtcaagtgcaaaccagctggaatgccctcgataattgccacttcttctgggccgtgactctcacccgccgtcatataacgcattattctgggtttccttccacgaattctttcattgctgctaactcttttttaacaatcacaggctcacctggcgccacaagggctaccaactgcaatgtgccagattgatttttcttatcattcttcaaatggtcataaaaatcgtcttgaccgatcaatggtgaaaagactggcagaccaactggcgccaaacgttcaaccaacgcatccgtcaatcccgattctgtattgccatcacgctcaaaacggtctgatatagtcaccatgccaaccgcgacagcttcaccgtggcgtagttcgccgtgtgccatcaattcgatagcatgaccaaaggtgtgcccgaagttcaacaccttgcgaatgccgccttctttttcatcagccatcacaatgtcagccttatattggactgattgttcaatcagccattgcgcattggcacgcacatcagcgaccgtcttcatccgaccggtccactgccaaaactcgccaccagccaaagctgacgttttcaccacttcggcatagccttcaattaggtcgcggtcgtctaaggtatctaaatattctgggtcaataatcaccaaatcaggctggtaaaaagtccccataatattttttacatcatccatattgatggcattcttaccaccaacgcttgaatccacttgggccgtcaacgacgtcgccacttgaataaaggcaatcccgcgcatgtaaactgacgccacaaagccagccgtatcaccaatcaccccgccaccaagggcaatcacaccatcttggcgcgtaaagccgttttcagccatcacaccaactagataattgactgcttcgagcgacttcgtttgttcacctgcgggtaacactgccggcactacttcaaagccattcaatgccaaattttgggccgtcacatcaaaataataagatgtgacatgctcgtctgaaatcaatagcaccttgcgttttgaccagaccttagccacttgttcaccaatcgcgtgacgtaaacccgcttgaatctcgatgcgatattgtttgtcaggtaatgttacttgaatcatcttatcccctcacaatttcatgaatcgcccgcgctttgtcggctaattcagtaaattgggctggcgtcaaagcttggtcaccatcaacgaacgctgcttctggatggtcgtgaatttcaaccatcaatccttgcgtgccagctgccaccgctgccaagccgactgacgtcacgtgatgcgccacaccagctgcgtgtgatggatcagccaaaactggataatgcgttaattcttgcaaaaccggaatggcactcacatccatcgtattgcgcgtgtacttgttatcaaaggtacggataccacgctcaatcaagataatttgatcattaccttctgacgcgatgtattcagccgcacttaatagttcatcaattgaggcactcatgccacgcttcaaggcaacgggcttattttgttgtccaagtgccttcaacaagctgaaattctgcatattacgcgtgccgacttggaaaatatcggtgtattgtccgacaatttcaacatcacgggtatccataatttcagtaatcatgtccattcccaagacgtcggctgcttggcggtgcatttgcaagccagcctcacctaatccttggaaactataaggacttgtacgtggcttgtatgacccaccacgaagcagtgttgcgccagcttcttgcacagctgcgcccattgccaaaacgtggtcagctgactcaatcgaatctggccccgccatcaagacaaagttgtccccaccaattgttgaatgtgctgtcgtaatcaccgtatcagctgggtgaaaaagacgcgaactcttcaacgctgctgggtgcttttcaatcacttcagcaacatcggcttcattcacaaatgggacttgcgccaacgttttaatcgtcgcaaaacccacgcgttcctcgtgtacgtacacattttgcaagccggctgttgtcgctgccgcgagaacctgttgcgctacttgctcattcttcatgactaaaatcatggttactcttctccttcttcagctggcataattgcctgcttcatgacattgatatcagggagttgacccgtccattgttcaaaactcaatgcaccttggccaatcaacatcgcaagaccgtcatctgcgtgacgtccggcggcacgagctgccgccacgaatggcgttggctcttttttataaatgatatcaaccacttggacatctggttgggtctcgtagaattgttcagttgaaagaatcgacacgtccgattgcattcccacattcgttgcgttcacaatcaaatcggcatatggcaaatacatcccaatttcttccaaatcatgcaattctactcccgccaaatcattgaccatcgcagctttctccgcgaatcggtcgctttgacgattgaacacgtgcaaagtcactgacttaggtgccgtcgccataatggcgcgggctgcgccaccagtgccaatcaagattacttgattggctggatcacgtagcgtgcgccaaaagcctgctccgtcggttgaatccccaatcgttttgccatcgcgaatcacgacggtgttaaccgctgaaagacggcgggccaatggcgtcaactcatccaagtacaacataattgcttccttaaacggcatcgtcacattgaacccagccacgcctgacgcaaccaaacttttgaacgttgcggctaacgcatttggcgcaacttcataggcatcgtattgcgcatcaatgccagcttgcttaaacgcggcattatgcattgctggtgattttgaatgacgggccgggtagcccaaaagtccatatcgtgtcgttgccatgtcagtgcgctcctcactcctgttgttaccttccagcttaccaaattaaagccaattaacaaaaaagaccgagcataaactcagtcttacttaatgtttattttacctaaaattagaaaaacatgccaatgccgtagtggatggcaatcgtcaaaagtccgataaccacgttacgcttaatggctttgattgggaatcccttaccaatcacggcactcagatatccggtcaacgcaacggccaccaccgtcgcaccaatcgtggcaagcatttcccaacgtggtgatgacaaaatcatcgccaacaatgggaacgccccaccaatggccgcacaaatcaaagatgaaacggcggctgaccacggactaacgtagtggcccaactggacatcatacttcgttgccaagatcgtttccaaaggtgccttggccatcaactcatctgcaatcttgctggcagtttcagtcgtcaccccacgtgacacataaaaggcacgaatatcttcagccactcccgctgggttcacgcgcaaacgttgcgtttcacgatcgacaaccaccttttcagcatccgcttgtgatgacactgatgcatattcaccagaagccatcgacaatgcacatgccaacaagtcagccaaaccagcaataaagattgtaaattgattgctcgtggctgctccaactgagaacagcacgccaacaaccgtcaaaataccatcgttcgaaccaagcacaccggcacgaatcgcattcaaacgttcttccatcgtttgatgggtcttaactttattattcataacgcaatcccccttagtgtccaatcaacgttccgatatagtacgtcaccaccatcgtgaaaattccggccacgatatttcgaatcgtcgcccgcttttcgttggcgccagacaggtgggcagctgaataacccgtaatcgccaacgcaatcaatacggcaatacccgtcgcaatgacacgttccttcaccgggaacaacgtgatggctagcatcggcaacaatgaccccaacggaaaggcaatcattgatgccatcgcagcgccaatcgctgagacttcgtggtgcaaactgaaaccataacgctcacgaaccgtcgtccccaaggcatcgttagccatcatttccctagttgcctgcgttgccaattcatcagaaatcccttgtgcagcatacttgttcttcacaaattcaaattcagtgtcgtattgcgtttgcaaggccgcctcttgcaccttttctgccttcacttgcgcatcattttgtgagtgaaccgatgtatattcacccattgccattgagaccgtccccgccaatgcaccagcgaaaccggcaatgaaaatcgcgaatgaatttgtcgtcgcaccagccacaccaataacgattcccgacacggacaggataccatcgttggctcccatcacggcggcacgaatcaaattattacgctgcgccagcgtttgcttatcatgttccttgctcatttccccaactcctaattattttttcctttaattagtttacaccgaaacaaaagatttttatttatgactataagtaagaagcgtaaataaaaaacgcgggaaataatttcctacgtttattttatctattgacctgtataacgaataatctcgatgtcttgatcatcaaacacatctttgaagaacgccgtcaagcagctgttctcatcatcaaacagattaccatcatacataaacgtcatgctaatcggctgttggctgtcaccttcgtaattgtaaagcttcttcaacaacttgccgttcgataattgcatgcgaatcataatcgtgcgttgcttatcatcgcgaatccaacgcttcaccacgtccgccttttcaccaaccaaatcaaactgccagttaaagccacgtgcaatgtacttcactgcgcgtacggtttgcttctgccaatccacaactgcaacgtcgcaacctcattgcccatatcagttacgctgatttcaccatacttgttgtatgacattgcgtactctggtttaaatggcaaatcattcaaatacgtcgctggtcgtaaacgaataccggcaatgcgatacatcaaatattcgcctggaaaaccattgcgatatgactcattctcggtcatattcaccacttgcacgtgatggtaacgccgtttgaggtcttttaactttgtgacgacatcagtagtcttgtcatcaatcaacatgattttcatgagtcgcctccaattttgtaatcaaatctaaccacttcgcctggacatgttcagcatcataatcacgtgcctgttcacgaccggcttcactcgctttttcacgccaacgtttatccgccaatgccatcacaatcgcattggcaagggcgttcacatccccatccgcgaccaacttaccggccttgccgataattgcacgcggaccataatcaatgtcatacgaaatcaccggcgtaccagctgcctcagcttccaaaatcgtacgaccaaagccttccgttcgtgatgtgaaaatcgtgacctgccccgtttgaaatgtgtcaatcgcatcggtcgtagcgccattaaacgtaatatagcctgtcgcatgggcgtctgagatttgttgttgcaactgcgtataataggcttggtcagaaaccgtaccatacagttgcaaattgatatcacgattttgcttgtgcgccttaactatgcgccttaactatggctgcaatcatatcttctatacgcttaatgcgatcaaatcgcgttaccactacgaccgacattgcgcgtcggtcagccaaatctgtcaccgtatccggtaccgttactgaagccggtgcaatatcaatcgtttgggcaccccattccgttcgcaaatcgattgcttgggtctgcgttcccgtcacaatccaatcgaacttcttggcacgcaataaattacggaagccaaccaaaatttgatgatgggccacgtggtgatcggcgtgaatataagccaccttcatttcagcattttcgacgctaccatacgcctgcgtcatcgtttcctctagcacatcggcatacatgatacttggctcttcagcggtcagcttgtccaagaaatatttcaccattgcttcgaatgacaagacatggagcatacccccgtcccacaataagacttgggtgaccttgttctgaacgtataacaaacgcatccgttctgacccatcccggttatacaaaatcgcgccacgtcgtgaaacactcttgttatcaaggccgtaatagatttcacccactagttcatcatgttgattaaacaccttatcaacaattgtcacctgacgggcatcatgcaatcgttcaacacggacgccacctgcaacggcctccccttgaaagtaatccatcatattgatgtggtgtgccataacattcggcgcagcttcacgccaaatttcttcatactgcggattgtagtcaaatgtgactagcttgacatctttgtttagattcttaaatagacgcacacgctccgtaaccgcatatgatcggccactttgaccgcgtccaaagaactccattaaaaataaatgtttcattagactccccctgctaacttgttcccgcttgcagtatatcaacaaatcatgggaaatatatgaactaatcatacaaaaacgccttcacaggtcatttcccgtgaaggcgtttccgttacttatcgtcgtgcttcttacttgtttcttcagcttcatccttgcgcttacgacgcttgaacaaaccgaggaacaaaccgaacaacatagccaaaccagttgccttagcaccctcttgctcgtccgaaccagtgtatggcaagacgcctgaatgctgggccgttgccgactcagcagcgctttgttcagctgtgtaagccaacgaagctgcactttcagttgtcgccgttgctgattgaactgccgtgtaggccaatgaatgtggcgtcaatacttcaggtacaatcaccggttcatttggtcccacttccgccgtcgtttgctcaggcacaaccgtgtacgtcacatactcagtgaagttaggtgtaccaactggaatatccacccctggtacaaggtcgcgatcagccacataacctggcatgcctggtacagcaacatctggcacatgtgaaccatctggcgccgtccatgggccatacgtcacttcgccagtaaccgtatcgaccgtcgccgtacgcgtgtacgtcacaatttgcgtcttcgtatcgacaatcgtaccgtcactagtgcggaagataatcgtacgcgtcgttgacgtcttcaagtgatcttcgtcaacaccagctggccactttggaccatctggattgtttggatcaattggcgtacctggtacccctgggttatttggatcaaccgtctttgtaccgtgcgccaacgtgacagcaaatgtttggttcaacgttgaatccgcatcgaatgtcataccaccagcaggataaccatcacgaacaagaacgtaaccttgggccacgtagtaagcgatttgctcagcggtcgtgtatgacgacttgctgtaactatcgcctgacaactgctcaacatggagcacttgcttcgtgttttgatcaatgaagttaaccttggcgtgttgacgatcaaccgtgtaaacaatggttgtatccgccgttggatcacttggcacagctggtggcaagtaacccttgcttgggttcttcggatcaactggttgcagtggcgtaccatctggaccttgtggcgtaaagccaggtacatatggtatgaccggataacctggtgaatttggatcagccgtcttcgttgggtcatctgcatcatttggatacgtcacttcgcctggtgtcttaacgcctggcacttgtggcacactaggtacccaagaaccaagttgacggtaaacaacttgttggatgtcatcttcactcgtttcatccatgcctgccacttcatcaaccaccaaacggtcagcgatgtagcccggaataactggcgatgtcttggcatcaaaggtatcatcaccattcactgcctgccaatcagagtaaacaatcgcacttgacgttgcggcacgtgccaaacgtgctcgtggttgcgcactctcttgggcagcgatgacgttaattgtaatcgtacgcgtaaagacaacctgatcggtaactgtcttagcagctgttgatccatccttctcatagatataagtgatggtctggttgacctcttcacgcaaatcttccgctgttaccccatctggccaaaccggtggttgtggccaagttggtgagtctgggtcatccggatcaaccggcgtacctggctcaccaagtgggtctgggaaggttggtgaatcgggatcgttaggatcaatcaaatcacctggttggtaaatcggatcacccggcacctttggatcatctggcgtaaccgtgattgtcgcacccttgaagtgaacttcaaaggattgatcaaccgtttcgtcacgatcaaacgtaaagtgacttgggtaaccattgcttaccaacatcataccagccaacttgtagaccatgatgcggttataagcggtgtacgtgctgttttcagctgaaccaccagtaatcgtatcaactgccaaaacgctacctgtctcatcattgatgtacgtaatcgtggccgtttgcttattggccgtgtacgtaatcgttgtgtcttcagtcggcgtctcacttggcgctggtggccagtaacctgaacttgggttatctgggtcaactggatccaacggctcgccatctggaccttgtggcgtgaagcctggtacatatggcatcgttggattatcaggtgttcccggtgtggctggattatcctcacctggcgtatccgttgtggttggatcatctgggttatttggataatcaattgacgtgcttggcacatccgttacgccacttgggaatgatggtacgtactgaccaattggtgagtaaacgaccttctctgacacatccgctgacgttgccgtcaaatcaggcaaagcagcgaccgtttgacgatcagccacataaccagcaatgactggcgaatcgactgcattcattgacgttaccgtcgttggcacccaagcactgtacgtgtatgctccggttaccgtatcaagggttgccgtacgcgtaaagtgaatggtttccttaaccgccgtcgccattgtcttaccagcttgatccacatacgtaatcgtacgtgtcactgactcgttcaaatcgattgacttcaaaccatctggatactttggtccatctgggttatccggattaattggcgttcctggcgtctttggatcatttggatcaatcgtttgtgaaccgtgggtcaaggttaccttgtaggcttgcgtgaccgtcgtatcacggtcaaacgtaaagtcagttggataaccatcttcttccagcacgtatccgttagccaagtaatcagctaagcgatcagccgttgtgtacgtacttgattcatccgaaccaccggtaatcgtatcgacaaccaatgtgtcgcccgtcacctcatcaatataagtaatcgtggctttttgttcatccgccttgtactcaattgtcgtatcagtggttgggtcacttggcaaagttggtggccagtaacctgaacttgggttacttggatcaactgggtccaacggctcgccatctggtccttgtggcgtgaagcctggtacatatggcaaccttggattgtctgggtcacctggatcagtttcattttctggtcccggtgtgagtggttccgttggatcatctgggttatttggatacgtcattgggtcactcggaacatttgtcgtatcggctgggaatgatggtacccattgtcccatcttgttgtacacaacattaaccgtcgtgtccgcatccttggcaccgatacccgtcaccgtagcaaccgtctgcttatccgccacgtaacctgtaatcactggtgagtccactgcatcaaaggtcgtatcgccattagcagcaacccaatcaccgtaagtaactgcacccgttaccgcatcgacagttgccgtacgactgaacgtgacggtatcagttgcatcatcagctgccgttgaaccgtccgcgtacttgtacgtgatggtttgtgttaccgattcgttcaaatcagtttcagtcaaaccacctgggtacgttggcgttggtgtgtcaccagggttaactggataagttgggctcgttgggtcgtccggatcaactggaccacctggcgtgaagattggtgaacttggcgtctttggatcatttggatcaactgtaatcacagcgtgaatgaaaatcacttcgtacgtttggtcataatcatcttcacgatcgaaggtaaagttgacacctggataaccatctgaaaccaagacatatcccgctgcctcgtaggctgcaatcttgtcagccgttgtgtacgttgacgtctcatcagagtgtcccgtaatcgtatccattgccaattgcttgccagttgtcttatcaagatacgtaatcgtcgtatcttgtgtcggatcagttggcgttgctggtggcacgtaacccttacttgggtcacttggatcaactggttgcaatgggccatctggtccttgtggcgtaaagccaggtacatccggaataaccggataatttggcgccgttggatcagcaggttgcgtagggtcatctgggtcatttggatacgtaatcggatccgttggtacatcaggcgtaccagctggatatgatggtacccattgtcccatcgccgtataagtcacaactgggtcagtgtcagcatcagttgcctgaatacccgtcacttcagcgaccgtctgcttgtccacaacataacccgtaatcactggtgaggcaaccgcatcaaacgtggtatcactatttgctgcaatccactcgccatatgttaccgcacctgtgaccggatcaagcgttgccgtacgactaaacgttaccgtgtcagcctttggatcacttgcctcttggacgtcggcgtaaacatacgtgatggtctgtgtgactgattcattcaaatcagtttcagtcaaaccagctgggtacgttggcgttgctggccaagttggaccacttgggttatccggatcaattgggtcacctggattacctggttcttctgggtacgttgggctatctgggtcacttggatcgaccggatcacctggcgtgtaaaccggtgaacttggcgtcttcggaccatctgggtcaatcgtaattgtcgcgtgcttcaagtgcacttcatacgcttgcgtcttactgtcatcacggtcaaacgtgaagtcatcagtaacgagcgtgtaaccttgcgccaagtacgcttgaatgcgctcagccgtggtatacgttgacgttgcatcagaaacacctgtgattgtgtcgactgccaagtccgtcttcgttgtgtcatcgataaacgtaatcgtggccgtttgctcattggcaacgtaattaatcgtcgtatcttcaccagggttgtccgtcggcgttaccggtggcacatagcccttgcttggatcagttggatcaactggttgcaatgggccatccggtcttctggcgtaaagcctggcacgtatggcaccactggataatctggcgcacccggttcaagcggttgcgttggatcatccggatcgtttggatacgtgattggatccgttggcacacttggtgtattagctgggaacgatggtacccactgtcccatttgcttatacgtcaccttaacgttttcatccccactattcgccgtcaaattagccgtttcatcgacttgcgtcaaatcagcatagtagccggtaatcactggtgattcaaccgcatcaaaggtcgtatcgccattcgtcgcaacccaatcaccgtatgtcactgttcccgtcaccacgtcatactcggcggtgcgtgtgaactggacgttatccgtcactgtttcagcagcttcgttaccattctcgtaaacatacgtaatcgtacggtcaactgactcgttcaaatcagtcgtcttcaaaccatcaggataagttggtgtcgctggccaagttgggccacttggattatctggatcaattggttcacctggcgtaccaggttgttcaggatacgttgggcttgatggatcacttgggtccaccggatcgcccggcgtaaagatcggtgaacttggcgtctttggatcatctggcgtaatcgtttgcgtaatacgctcaagttggacgataaacgcttgatcagttgccgtatcacgatcgaacgtgaagtccgtacctggatatccatcattgaccaaacggtaaccttgttgctcatacatcgcaatgcgttgtgctgtggtgtatgaacttgtttcatcggaatgaccatcaatcgtatcaaccgacaaatcagtatcagtcgtcacgtcgtggtacgtaatcgttgccttttgttcatccgcaacataagtcacaaccgtatcaccacctgggttatcggttggtgttgctggtggccaataaccaccttctggtgaacctggcgttactggttcaagtggcgtgccgtctggaccttgtggcgtaaagcctggtacatatggcatggttggattatctggcgttcctggcacattcgtatttgaatcacctggttcgagtggcgtatcggcatgagctgggtcgtttggatacgtcgttggatcagatggtacgttttccgttccggctgggaacgatggtacccattgtcccattggcttgtagacaacttggacggtttcatcccccgtcgttgccgtcaagccagtggtttcagctaccacttccttatcagcgtagtagccagtcttaactggtgagctcaccgcgtcaaacgttgtgtcattaccagttgcaacccacgcaccgtaagtgacttcacccgtcaccgcatcaactgtcgccgtgcgtgtgaagctaaccttatccgttgcagcatcgaagaccgtattacctgcctcatcaacgtacgtaatcgtgcggttaactgtctcgttcaagtctgtcgtcgtcaccccagctgggtacgttggtaccgctggccaagttggtccgcttggattatctggatcaaccggtgtacctgggtcacctggtgtatcaggtaccgttggtccatctggttggtctggataaactgggtcaaccggtgtgtatgggctttccggataggttgggccacttgggtcactcggatcaaccgggtcgcctggcgtaaagatatccgtgcccggttcctttggactacttggatcaaccgttacagtagcttgcttcaagtgcactgtgaatggttggtccgtatcatcaacacggtcataaaccacaccacctgttgggtaatcgtcgctgacccacacataacctgcacgttcatacgtcgcaatgtcggtcgctgtgcggtaagcatcagtttcatcagacttacccgtcaaatcgacaaccttcagtgtgttacccgtcgtatcgtcgataactgttacagtcgccttttgttcattggccgtgtaggtaatcgtcgtgccaccacccggattatcggttggcgttgccggtggccagtaacccgcacttgggttgtttggatcaaccggctccaacggcgtgccatctggtccttccggcgtaaagcctggtacgtatggcaatgttggattatccgtgtcacctggcgtatccggcgttccctgacccggctccaaaggatcacccggattatctgggtcatttggatacgtaattggatcacttggcacattttcagtgccttctgggaataccggtacgtactgtcccattgggtagtacgtcaccatgtaactacgatcgaaatcacctggtgcaatcgttaccgccaaaatatctgagatatcagcatagtaaccgtccttgaccggacttggcgtctctggccagtcatcatcaccagccgttacaacccagtccgtcgttgaaatttgttcaccagtcactgcatccagtgtgattgagcgctcaaacgttaccgtacgcgtgacatctgggaacacctcatctccatttgcgtactgataactaatgagtccattaatcgtctgcttaacaccatcgatacccgttccctcaggccaaactggcgtatcaggtacatctggatacattggactacctggatcaccaggagtgtctggtgtgaccacaactgtgccgtggtccaagtagacataagcaaattgcgtcacgttgtccacattgtcatagtttccagccgtcgctgttgcgtcttggttaaccaagacatagcctcgtgcagcataatctgacaacgtatttgtgtaggctgcattcgtcgttcctgtcaaggtctgttgcaaacttgtgacttcgacttctgttcccgatgaaatatcaacgtaaaccaccaccaacgtttgtgggtgtgccacgtagtaaattggcgtatccgctgccagattatccagtacagctggcgggtagtagcccttcgtcacatcgtttggatcaatttgctccaatggcacactgctaccatcagaagttggcgtatatcctggaatatacggcactggcacttcaacatagtttggatcatcgcgcgtccaaacctttgaagcatcgtttggatcatttggatagacacgcgtcttcaattgctcatcttcaggcaagtcagggacgtgcggaatccaagaacctagcttcgtatacgtaacagtctcttcacgattggcatcgttgtaatcaaccgcatcaccagcaactgagccttcactagcataatagccatcaattactggcgtttgcacatcgtcaaaattctgtgactcagcaggccaaacaatcgacaatacttcaccatttacagcgtcatacgttactgttgcggtaaaggtctttttctgtacgctgtcaggcttggcctcactcttatccgactcataaatgtagtgaatcgttgacgtaactgttgatgtataactgtcgtggttcggatcgtcttcacgtcccccatccacaactaccgtaccgtgggtcaagtgaaccaagtaaacttgggttgctgtgtcatcacggtcatacgttccggcagttgcttccttatcggatgaaacgtacgtatatccaagtgatacataatcagacaatgtatttgtgtatgcctgatcagtctcccctgagaaagtctgacgtagctcgttaacttccaaatcggtcgtgtcgtcgatataacgcacaatgacttgttgtgtattacgcgtgtaattaatcgttgtatcccctgtcggatccgttggtgctggtggaatataaccagctgatggattttctggatcgaccggcttcaatggtgtgccgtcaggtccttccggcgtgtaacccggtacatatgggataaccggctcacccggctcggctggatcatgcggcgttaggttatccgttggattgtttggatcatttggatattgaattggatcactcggcacattttcagtatttggtgggaaacttggcgtccaacttcccattggcttgtatgtgacggtctactcagtacttgtatcattgtggtcaatttggtccgcatcaacttgcgtcacatcggcaacatatcccgtgataactggactcttaaccgctgcaaacgtggcagagtcattaggccattccaccgaaatcggtacatttgaatctactttataagtgactgtcgccgtaaaggtatgatctatgaaactatctggcaccgggtcaccatttgcgtccaccatttgattaccatcttggtcaacataatgaattgtgcgtgtaattgtttttgtgtaatcagtttggtttggatcatcatccttaccaccgggtactgattccgttccaattgccaaaataacgttatagacctggtcaggattcttctcataatcccacaattcgtgggtatagtccgcattcgatttaccactgaacgtttcagtattcacaactgtacgagtaccatcatccgcgacatagatgtagttaactgttactttttgctcattcgcatggtaaacgattgtcgtgtcagttgttggatcttccggtacatttggtggcaaataaccaccagttgggtcactcggattaaccggtgtcaatggcgtgccatccggcaattctggcgtataaccaggcacatatggcaccacaggtacagaaggattcgtacgatcaggctgtgttggatcatccggatcatttggatacgtcacatcagtcggtgggttatccggtgttgtatctgggtagcttggtgtccaagcacccaatgccttatacgtcactcggaagccaacgctggcagagtcgtagctaaccgtcgctgctccggcctgtgccaaatcagcaatgtaaccttgaataaccggtgaatcaacgtcgctaaacgtataactttgaacattccacgtatcatacaattcctcaccagtcaccgcatcatacgttacagtcgccaagaaagtagtcgtttgaatattagctgccgcagcaactgtgttgtcttcatagaagtaacgcaccgtcgactttacttcccacttggcgttaccatctttaccaccttcaacatcaactgtgttgtggtccaaatagacgtaataagtttggtcagttgccgtatcgttgtcgtacgtccctgaacggcttcccgcgtcctgcgccacaatggtataaccctttgccgcaactgactgaaggacgttggtataagtcttaccagtatcaccggtcactgtttgcgtccagtctgtgatttcagtaccatcggctgctgtccatccctcagttttttctgaaccgtggacgtcaatatagtgaatcgtaacagtttgcttatccgcaaccaaagtaatcgtcatcgtttgcaagctactgtcagtcgtacttaaattgttgttcgttgtgtcgtacgttcccgacacagatgtaccagaaagcgtcatggctggcgaaccggtcgttgtcgtcttgctggtgtcgatgtgatatccggccgggatactacttgcaatatttgtgctcaacgcctcacctgttttaccagataagttaacatttgctggtgcggtcgttccatcagccatcacaaacttgatttgcgcttgttgcgtgtccttgacatagtacaacacaatcgcatcggcagccgagtctgtcaaagcatatccgctcttagacgtacccgccgtggcgttatacttggtcgccgcactttcacttggcaaagcgtacgtaccgtcggacttcttggctgactgcaaatccccaccattcaatgtaaatccgacgtatgtgtatcccggcactttggtattgatagtactccaatcgttgtttggagatgcagtcgttttcacaccgatttgcgcacccgtcacaccttgcaatgcggaattagactgaccagcggttgcgttattatagtttgaaacaccagccgtgttggcaatagaagttgaattggctaatgagaacgtcccatcagcattctgaacggccgtttgtaggccaaccgtggccaactgtggcgcggcaacgtagtaaaaattaacacctgattcactaggcaacaatggttgaatataaccacccaaatccccaagcccagttccgccatatgctaagaagctaccaccgtcaatcgaaccgtttcgatcttcatcggcccaatcaggggttgagattacagcattcgcgttaccaaaggcgtccgtggctgacaaggtgtacttaccatcactcgttttgtacaaatcacctgtgattttggcatacgtcatgccacttgtagtcggttgtgatgttgctgccacaacacttgtcgccccagtagccgtatttgtcgccaaatagaatgtcaatggcttatctggaattgtatatgtcttcaccaaattgggtgagacagtggttgcgccagcagtacgcatcgtaaatgtaatgacattcgtacttccactccacgtaatttgagtcatcgacgttacattaccgttagcgtccactgccggccaataaacaatcgtcgtatagttcgctgaattagtttgattagtgaacttacgaataaccgcatcctttggcaccgcagacacatcaaatccataggcacgtatcaacgccaagttaaatggattgttcgggtccataatcgcatattttgaacgcgaatccgcaatagaataagcatctgtactcatactagtaaatgcacccgttacggtttgcgtcatacttgtcccactaccgttagttgtcacactcttttgagctgacacttgggtcaacgatggtactaattggtaaccaggtagaacgtcggatgtaactgtaaattcatcatcatagccacctccagttccaccaatcaattggtttaccttggcatcagatccttgtccagcacttgtatttacaggaattcggtccgttgttttagtgtaggtaccgtctccattatcaatcgcatagtaatagttagcatctgcagccgtagcaaagacattaatacctgccattcgccaatttgtaactgccgttgtaccttgctttattccgctagaaacctcgtagtcaccagtaccattgatgatgttatttttaaatgttgttccgccaacgattagtgtcccgccataggcaacgtactgacgccctgtaatcccactatcgttataactcgtcagcattacagtacttccggaaacaaccttagttccccatgggtcggttgtaacgtttcgagcaacaccaactaaccacttcgttcctgttgtatcagtgaacccgcctgcgtagtaatagtagttcaacaaattcgtatctttttggaaatacgctggcaagtttgaactattcgccaccgaatcgcctgttggcagcgtttgtccttgagtacgacgccaagcttcagacgcaaccgcccagtccaaaccattcgtttcagcccacacgcgaatgtcgtcgtgatcaaccgaatcaaacgtttggcttgcttccgttgaatctggccagtaaacaacaaccatcccgttgtcattcataacttcggttgctggcaacaaattgaacgcatccttgttgaacatatcaaatgttgcttgttgcgcttccgtcaaaccggtcgttgtatccttttcttgctcaccttcctgtaagaatgaaatgaccatgcggttgcggacggcataggccttcaaagcatccatgtcgatgctgttgaagttgtacgatgctggcaagttaatccagaggtacttatccacgtaggtgaccgtaaccgtgctacttagaccatagtcagatccggtaaagctttccttgtttggaatagtgatggccgtgttaacagaaaccgttacgccatcggcttcggtttcatcctcagttgtgctatcgtctgctcccaaaacagttgctgattgtgagctcgatggtgcaaccgattgcaatgagtctgcgctactcattgctgattcggctgaagatgactcagcttcactccaggcgccacgcttgtgagtgtgtctgattcaccctcggatgagacgctcaccaaactgtcagatgcgcttgactcctcattgcttgtcgcactacttgattcgcttgatggcacgacactcactaagctgtcagaatccgtttgactcgcctcacttgacgcatcagatgaatccgttgacgtagctgaactttctgaagctgcagatgtggtcgacaaaaccaccgaactagccaatgaactttggcttgtgaccggtgattggacaactgattcactttcactaacttccgcagtgcttgaggcaacactttcttcaggtagactgctcgtttcagaactcgcactctccatgacaactggatcaactggcgtttcagggactgactcaaccactgattcttcagacgccgtagcctctgcgctagccacgactgagtccgggtcacttggattggttgggactggttccccagtttcatcgtccaacccatcgccatccttatcacgttcttcaatgtcttggtcgtcatccttgtcagatgagctcaccaaagaagcatcagcatcgtcaatcgttggatcttccgccgctgaaacttcaccgcctgtgttagcccccataccaatggcaatcaacaatgacgtcgcaccaaaacgcagccactgcttattcttcttattgccaccaccggcatcttcgagattaatttctcgctcctttacacttgtgtctgtagatttcatgattttaactcccctaaaattcaagattgtcaaagtatagacttcgaccattgtcgatagtttagctcacaaaagtactaaaaagcgggaactattatcgacaaaaacacccctattacatggtcaaaatctacttctgtacctaaattttaacgaactgcgtccattaaagctcttttgacgtatcaaattacgaaactatggttattttatgaaaaacgcgcaaaaaaagacccgatagcagttgctaccgagtctaaaaattatcgtgcgttttgacgattaaagaatgtcaaaactggaattccaatcagtggcactaagattgccccaacaatgatttcaaaaacaccgttgaaaccagcaattgaaacaatcaaataatttgcaagtcctgaatcaggaattccaaacgccgttgtgtgcatgaccgtaaagccaatccacgtgatactcaacacgaagaacgtattcacaaaagctgacaaagcgcctagccctgctaaccaaatggtttgttgtcccattggacgattcttaacgaagcgccagtacaagtacccgataatcaatccgaccaacatacgtggcacaatcgctgtgattgggttacggaagatcaaagccccaatgcttggtgctgatgtccaagcgtgccaaagtgaataggcaccccaaacgaaacctagtaacgcaccggcgcgaggccccaagaccatcgccccaattgcgacagtaaacgtaataatcgttaccgctgccccaattgcgaacgccccaagtggtaatgtgcccagccaaggaacaactgactgtagcagaataattgcaataaataatgccttcaaaacgagatgacgacttgaattaggacgtgctgccattctaggcctcctctaattaaaatccaaacaaacttgtgtttacttaattatagttggcaagcttgttaatgtcatcaactaaaaaggcgccagcataacgaaactggcgccttcgcggcaaaactttggttttgagatattttttgagattcgtgagaggtacaaattgttaatcgagttttgccgcgatgtttgctaacgtgacgtcggcagttgactcaaagcgaatgtcagcgtcgtgcaaaatttcggcgttaccgattcccaatgacacttcgccagccccgttaattgcttgaatacccgacgcagcatcttccaaaccgataacttgctctggtggcaagctcaacagctcagcggcgcgcacataaatttcaggatctggtttgtttgcagttaacgtacttgggtcaacaatgcccacaaatgaatccgtcaattgcaaacggtcaagaataaatggcgcgttctttgaagctgacgcaacactagccttgtagcccttgtcgttcaattccttgatgaaatctgccatccccggcaaaatatcgtccggcgtcaaaccagaaatcaattcaacgtagtggttattcttccaagatgccaacgccaccttttcatcgtgtgtgtagtcatcttgcttgttgccagccttcaaaatcatctcaagactgcccatacggtcaatccccttcaatgactcttgcaattctggcgtccaagtcacgtttacttggtccgcaagggcgtgccaagcttgcgtgtgaaacttagcggtgtccgtgatgacgccatccaagtcaaaggcaaatcccttaatttctgaaaatttcgtcatcttaggcctccaaagttagtttttcaccggccaaatcaatcgtcaatggctcaccagacaacaattcgacatgtgaaccattttggtcaacagcgactgacaacaagcgaccgcggaataggaagcggaaactgtagccttgccacttatcaggcaagaatggttcgaagtgcaattgatcatcgcggacacgcatgccagcaaatccttgcacgattgatagccaggcccctgtcattgacgtgatgtgcaaaccatctgacgtgtcgttgttgtagttgtccaagtcaagacgcgccgtacgctcgtagaactcgacactcttatcggccatcttcaagtcagcggcgataattgagtgaacagatggtgacaatgatgattcgtgcaccgtgaatggctcatagaattcatagttgtcacgcttttgttgttccgtaaaggcatctgggaagtagtacatcgcgtgcaatgtatctgattgcttgatgtatggtgaacgcaagatacggtcccatgaccagtgttggttaattggcaagttctttggatccaaatcacgaactggcaccaattccttgtccaagaatgtgtcgtgcgcagcaaagacgtgacgtggcacaccgttgacgtcagtaacgtccgcttcaggcaagtacatcttgtcgacaatatcttgccagtgcttgcgttcttcagctgtaacgttcaacttcgtttggaactctggtgcaaccgcgtcgatgttttccaaagcgtatgacaagacccacttagccatccagttagtgtagtagttgttgttgatgttgttctcgtactcgtttggtccggtaacaccgtgaatcatgtacgcatcgttgcgtgctgaatagtgcacacggtcagcccagaagcgcgcgataccaatcaacacttcactaccctcgttttcaagccatgaacggtcacccgtcaagtgcgtgtagttgtagatggcgtatgcaattgttgagttacggtgaatttcttcaaacgtaatttcccattcgttgtgtgattcgataccatcgaaggtcaccattgggtacaatgccccagccaagccttgttgctttgcattgtggtaagccccttcgatttgttggtaacggtacttcaacaatgacttcacgacagctggatcagtaacccctaggtaaactgggatggcaaaagcttccgtatcccagtatgtggcaccaccatacttctcaccagtgaagccctttggtccgatgttcaaacgcgcatcgttaccgtagtaagtggcaaacaagtggaacaagttaaagcgaataccttgttgggcttcttcatccccttcgatttgcacatccgccttctcccaacgcttagcccaaccagttgtgtggtcgatgaccaaatcgttgtaggtatttgatgcaatgtcagcaaacaaatcatccgtggcagccttcacagcatcgttggtgtcatagtcacgtgatgttgtgacaatgacacgcttttcgatttgaacaggcgtttccgtcacgataccagcaaagacgtttccgacttgcttgtcatcattgactgacccaaccgctggcaaatcagatacgaagcgttgacgagcggcaactgtaaattgtggcaccccaaatgggttagcgattgtacgggtcatgataaaggctgattcttcatcagcttccttatccaacacatcccagaacttctcatcgtaatttgaatcttcgttcatgacatcggcatcaatcaaagatgtcaattccaattggtgtgtcgccttgtcgactgatacaaaggtccagcgcaagtcagccaattccttcttggcaactgagataaagcgatcgacgctaatcttcacacccttcacgatgaatgaacggtgcaaaataccagccttcatgtccaatgacaactcaaaatcatcaaatggcgtcttagccaaatcaatcaagtcaccgtcaatgcggatttcagccttcacaaaattcaaagcgttgatagccttaccgaagtactctgggtacccattcttccaccaaccaacacgggtcttgtctgggaaccagacaccaccaatgtagacaccttgcaatgagtcaccagtatacgtttcttcaaacataccgcgcatacccatgtactcatttcctaatgatgtaattgattcttgcaaacgcttgtcagcaggattcaattcgtgcgttgtaattgtccaaggactaacttcaaaaattcgtttcatgttattattccctcataattagcgcactggctcggtccaaatgataaagtcgtttggtgccagttgcgtctcagattgatttgtttttagcaaaatagtggctggctgctcaaccgttaaatcagccgtaccattgttgaataccccaacgatgcgcgtttgattatcttcacgcgtcaatcgaatttgacgatcccaaatcacgtcaaaggtaattttatcgtcagatagctttgcaatgttctggcgcctgacttgtactaatttttgcataaagtcgtacaaatcatggtcttgtaactctggctgccaaaccatcggcttgcgatcatccggatcgttttccccagtcataccatattctgttccatagtaaattgatgggacccccggctgcataaaggtaaatgcgaggatacttttcgctagttgcttatcttcatgcgccaaggtcatcaaacgtggcgtatcgtgtgaatccaaggtgttgaacatcatgcgattcgtggcatcacgatacaacatcaattgatggctcatcttttgaaccaacgtgtctgctgattcattctccaagaagtattgcagaatggcaccagtgtagctgtagttcataacggccgtaaattcgtcgccgaccaaccagctctgcgatgtgtgccaaatctcacctagaatgtaaaaatcaggtttcaatgacatcatcgcatcgtggaatttacgccagaaatgatgatcgatttcgttagcaacatcaaggcgccaggcatcgatatcaaattctttaacccaatacgtcgcaatattcaacaagtaatcaaccacttctggattactcgtattcagcttaggcatgtgtggcgtgtaatcaaacgtgtcgtacgttgcatcggctgcaaattcaaagttatccgttggtgtgtacgttgctgggaattcacgaatgtggaaccagttcgcatacggtgatgcttgcccgttctttaatacatcctgccactggatcgacttgtcaccaatgtgattaaaaacggcgtccagcatgacgcgaataccacgttcatgcgctgcttgaaccagttgcttaaacaacttggcatccccgaaatgtgggtccacggtcatataatcttgcgtgtcatatttgtgattcgatggcgcttggaagattggattcaaatagatacctgaaaccccaaggtcttgcagatgatccaagtgatccaaaatcccctgtaagtcaccaccgtaaaaatcttcacgacccggatgatccgttgagtcccaagacttcgtacccgtcggatcatttgatgcatctccattggcaaatcgctctgggaagatttgataccaaaccgtatcggtcacccattccggggcgttgtactgatcaatcgtttgaaaaaacggcattcgaaagtaaaagttcatatccatcaaatcggcgtcagccactttaaagaaacctttgtcactataaattttctggataccgagcatatcagtcactaggaaggcatatgctaaccgtcgcttcggctcggttaccgtcacctgccaaaaatcagaaatcccatctgacataatcttggtcatctgctttggcacttggtagaacttttcatcagtcggcaagctccgcaaactgtacggatcacctgctaataattcaacgttaacaatgtcgtctttggcagtacgcaggcgaatattaacggtttgctcattcacgacatacgccatctcactgtcgggacggtgcataatacctgctaggttcataatgctcccctctcttactgattagcgcacgctgtcaccgtgttcgacagacgtttccttcacggcccaaacactaataccacccaaaacaaacaagaatgctgataccaagatcatgtgtggcatgtggttacccaacattgggtaaagggcaaatgatgcaactgaggcaacaatttgtggcaagcaaatccatgagttaaacaagcccatgtaagttccgtcgtgttgtccgtccaatgcgttcgtcaaaatcgtgaatgggatagcgttcatcgtaacccaggccatacccaacatcacaaacgcaactgctgacatggtctttgatccagtcgtagccaacaaagcaaatccagcagcaccaacaatcaacccaaatgtgtaagctggcttacgcgtcttgttgttcaaacgtgaaataatcaatccccaaacaatggccgtaaccgtttcaatggctgacaagacaccgaaccagttaccagcggcttggaaggcacctgaagcagcgttcgtcgtgtgccagatgttacttgcaaccgtacctgttccatacgtccataggtattggaaaccggcccagctaaagaactcaaccaatccaagtgtccagaaaacctttggtgcgtgctttaggatttcgaagacgttttgcttctcgcccttttgctcatcaagaccgtggtagtttgcgtacgtctcaggatcgtattcatcaaccttccatactgtgaaagcggctgaaatagccaaaataattgctccaacatagaatgaccacttaactgatgctggcaattgtccttgagcggcaacgttggcaacaccaatggcagtaaagaagtatgggaacaagttggcgataactccaccaatgtttccccagatggtttgccatgaccaagccatatccttttggctatcgttaaccatgtctgaaatcatcatcttaaatggttgcattgacatgtttgatgacaagtccatgaacaagatggcaatggcaccgaaccacaaagcagttgatgtcttaaaaccaaatgaaccggcgtttggcaacaaggccatgacgacgatggcaaccaaagctcccaaaatcaaatatggcaaacgacgaccaatcttaggcaaccaagtacggtctgagaagtaaccgaccaatggttggacaaccattccagccaatggtggcaaaataaagaagaatcctagcttcgtaggatcagcaccaagcgtttggaagatacgtcccatgttggcactttgcagtgagaacgccatggaagtacccaaatttccaaacgtcatcaacatcaatgtcgcgattgttagcgttggtagatgcttcttaccaaccttgttttgcgattctgtcatgattcaacctcgtaatttcaaaataacctatctgtgaactgcaaatgaaagcgctttatttacaaattccactatagctctcttgattacaaaatgaaagcgttttcagaatgttaccggtaacataaaattacattctgcctgcatttgaaagtatgctacacttaatataagttgggcgtgttagcgctttcattgattaggaggtttattcatggtctcacttaacgacgttgcgaagacagctcatgtctctaaaatgactgtttctcgtgtcttaaaccatcccgaactagtctcactagaaattcaggaagatgtgcaacaggcaatccttgagcttgggtatgtacagaaccgagcaggccgtgccttggcgaacaagcggcattacaacatcgccttcgttctacttgatgatattgcagaaattgagccgtattatgcgcatttattgattcatttaactgatgccctacgacaccacggctatacattggaagtccgccacgaccgtgaatttgatttaacgaatgtggatgcctttttagtgagtggtgcacgaaggtcggatattgaggcactgcacctgcctgttcccgtggtaatctatggcatggaacccggtctaatttcagtagacagcgacaatgccgtcggaactgcaatggcaaccgagtatctcatcaaccacggttttgaacatgtcatgtatcttggtctcgcaatcaacgagccgttcgcactaaatcgcgaaacaggttatcgacaaacgatgttgaaatacgggttaccaattgaagcgtatgagttaccaaataacgagtgtgctgcgactgagttgattacattaatcaaccctgcccccggcactggcattgtcacagcgactgatcgtttagcgctcggtgcaattagggccagtaaggcacttgggttgtcattcccgaatgaaattgggattattgggttcgacggtatttacatccacaagttatcctcacctaccctaaccacgattcagcaaccattaggcgtgattgcgaacaccatggtgaaattattgatggcacagctaaacggcgaaactgttgcatctgaactcattacgcctaccttagtaattggtaattcgacgccgtagaaaaaagcttccgaaagcagtaaacgctctcggaagctttttcaatatttatctcaaaatttcaatcaaattcttgcgtgatgcttggcgcgctggcaaccaaccaaagataattccaatggcagttgtgacaccgaagaccatcaagacattgttcattgtgacgacagctgtaatgtttggattgtccatcacaaccgtaatcaacttacccaaaccagctcccattgccaaaccgatgacaccacctgacaaggtcaacatgaccgcttcaatcaagaattgcaacaaaacgtggcgttccgtagccccaacggccaagcggataccgatttcttgcgtacgctctgaaactgaaatgtacatcatgttcatcacaccgataccggcgatgaacaatgaaataccagccaccgctgacacaaacagggcaatcacagatacatacttttgcaatgaagccatggttgcaccttcatcttcgaattggtacttaccagaagatgcttggctaccgttcttttgcaagtaatccgtgaccttttgggccaccttacctggcttatccttggttgcaatcgtcaattgtaccattggataagaagctgtttgggtacccaggaacgtgttgtatggcaaccagacttgcgctggcatttccattgatgaacctgcccccatctttacaacaccaacaactgtataactcaagccacccaactcaatcgcttgattaaccgctgcatgggccgagccataatacttctttgcaaagtcatttgcaatcgtgacattacgctgtgccagctcattatctgacttagttaacttacgaccagcaattaactcaacgtcgccactgccctttacgaccttagcatttaaattcgttaacttctgttcaccggcgtatccgtctaatgttgtcgatccactctcaagacgcttcaatttaacgttcgcaatcttgtcagcataagggctgttcttgattgtgttcacatcggattgatccaatccatttgaaaagtagtcatcttgcgtgtagtaaatggtttccttaatcatccccgacttgtcagctgagacgaacttggccatttgcttgttcacaccgttaccaatcgacaaaatcgtgataacagatgcgataccaatgataattcccaacatcgtcaaaattgaacggcgcttgttagagatgagtgactgccatgacgacttaataattccccaaaggtccatctcacatacctcctacaatttgaccgtcagccaaacgaattgttcgttgcgcttgttcggcaacatgggcatcgtgcgttaccatcaaaatagtggttccttcatgattcaacgcaataaacaaatccaaaatttcttgggcagtatgactatccaacgcaccagttggttcatcggccaacaagaacttaggcttcgcaactaatgcacgcgcaatcgcgacacgctgttgttgtccaccagataattcagaaggtttcttgttccctttgtcaccgataccaagacgatcaagcgtctcttggactgcttccttgatatctgagcggcgacgtcccgcgtataccaatggcaacgcaacattgtcgaacacagacatttgttgaatcaacttaaagttttggaaaacccaaccaatattacggttgcggaaagctgcatagtcgcgacggcttaatgttgttgtgtcatcatccgcaaagaagtaatcaccttcaaactcacggtcaagcatccccacgatgttaataaacgtagatttaccagaacctgatggccccattaccgccacaaattcaccgtccgatatttcaagtgaaatgtcacgcaatacgtgtaactttgattcaccgttttggtaggtcttattgatattcgataacttaattagcgtcatcaattgcctccccgttcttagctgaatcataatcggttacaacgcgatcacgttcagataggttagccgtaacgatgacattgttatcacctgtgtgagcatcaacaaccgtcttcaccgcgcgaccatttacgacacggtaaaccatcttttggccgtcgaccgtctttacggcgctcttaggcacaacgataccgtgttgtgcaagtgaaaccgtcaccggttgaccataacggaatgtgtcatccaacgtcaccgtgaattcgtacttggctagcttacggttactgtcctttgttggcacagcgctgactgtcaagacatgttgcgtcgtttccttgttgtgatctgaaacaccgtttacagtgacttcagcatctggcttaaccttgtcgtagtcaccatcgctaactgtcgtcacaacttccttcttttgtgagtaaacttgtagctttggtgcatctggatccgtttgatctagcacaacaacaccatcaaactttgcaacggccgttgtagcgaccttggcttggatgtttgcaaccttggcttgtgcggccgtcaaatcattttgggcttctgacaaggccatcttggcttgtgtcacggcatcttggctgccaccatcttctgaattcattgccttttgggcattatttagggcttcttgttgaatacccacagctgcttgaagcttcgttacctcagcctgtgcttcactaacatccgccttaccatcggcagcttccatcgtcatcaaagcgtccccagccttgactgtttgaccgtccttgaccaaaatttgaccaggcttcatgctacccaatgcgacttcttgaatctgcattggttgaaccacaccagattccttcaaatccggttgttcttgcacctgagttgtggcaatcgtatgcttctcatctgacttaccaaattgcgtcacaaccacaccaccaacaactagtacccccaaagtaccgccaataataatcttcgttcgcttcttcatttttctctcctaaacaataaacccattcgtactacttctatatcctacatgacgactactactttgataaataacccgtcgtttcttaaactttttcttgtcacctgtctggtatttagtacgcatcgttgtatcgcgtatacattttgaaaatcccgtaaaaaaatccaagtgctaataggccatcaaccactcgtgctgcccattcgcccagacccatccaatctaccaaataggtctcacctagcgaaacgacaataaacacaatcaagaagacaacaaagaaaaccggacccttggcatacttgaaacgtggcataaaatgagaaacgcccaaattaaccgccaagccaatgaaattaacaaataaaaagacgagcacaatcgcaccggttgagtctgctacaccactaaagtgcaatgcattgtcagcttcactagcgtttaatcctttttcgatggccatcatcaccaaacgataaaccccagtcacaaccgcgacattgattaaaatcaccaacaaccgaacaaccaaattactgattacaaattgccagtttgtcgcaggtagcaaaaccaacttcgcattttgccatgactggactgattttacataagccattatcacataaaatacctgtccaaagatgactggtaggccaatcgctaatgataatgaagtaaatagctgagaacctcccgcttgccagctgtctttgaaggcgattgccagcgcaacaatcataactgcaccaactgcaatcaaaaatgttcgaaacccttcataactatctttcgcaatgaacttaacgagcttgcttgtcttcatcatgattcaatcccctttcgattctccgtaaccacctggacaaaatattgttccaagctcatttgctcagttgaccgaatttcgtcaataccacgatcaacgataatttgcccatcctgaatgacaagggtacgatcaatgactgattcaatctcgttaatttcatgcgtcgacatcaacacaattgatgattctggtagccaacgtagcaagctttgcaacacgcgacgacgcgtcatcacatccacaccactgaacggttcatccaaaagaataacctttgcttcgcgtgacaccgttaaggcaaaaatcaaacgttccagttgtccctttgataacttgctgattttagcctgattatcaatcttaagatccttacgcaaggcttcccaacgcgcactatcaaaatccacatacgcatcctgataaaaagccgccaccgatgcgaccgtgtctcgcttcatcgcccaatttaggtttggaataaatgacactagcgacttcaacacatcgcccgattgatcatcaatcttaatgactgccccatgttctggatgaatcaatcccgctaaggcccgcataaacgttgtcttacctgccccattttcgcccaaaacaccaacaatctccccagcctcaaccgtcagcgtcatctcttttaagatttgacgtaagccggttcgataactcaaattctttacttctaacatccccgtttaccccttcttgtactgtgacaccacttgcgtcaaaatatcctgcaattcagcaattgagacaaaagccaaactgtttttaacaaacgtttccgtcattgccgtaattttattgcgacgaatgcgctgaattttttcttgatccgtcgtcacaaagttacccaacccgcggcgtgtttcaactaagccggattcaacaagtcgtgtaatcgcattttgaactgttcggccattgattactaattctgccgccagttcacgtacacttggaaccttactccccatctcgtatttgccatcgagaatttcactttccaaataatccgcgacctgaatgtataagggttcgttatcattaaactccattatcagccctcctgttacagtgtagtataacagtgcaacacctaagatacaagaaaatcgcgaacgatttatcagtggttaccagttcgaccaaatcataacattcccgatgattagcggtaacgttggcaaaataaaaattggccaacgtcccttaaccattggtaacaagattgattgtaatccaaccaagataattgataacaccgttgtatgcgataaaacctctttcataaagcccatataaactcctatcaataaaatccaatgcataatcaatatattcttttatcaaatcttatttataatcattttttcaaagaatttaaaaatgcaaaaacaaccccagccaaggcaattcttagctggggttagattttatttatgaaaattaattattgtccacggcgctcagcaaagtacgccttcatgcgcttcattgcttcagccaagtcttcatctgatgcagcgtatgaaatacgcacgaattcaggcgtgtattctgagaaagcatccccaggaatgatggcgaccttggccttttctgccaaatcaacggcgaagtcaaagccgctcttgcccatgtcttcaggaatcttcgcgaagatgtagaaagccccttctgggttaaccatctcgaaaccaagttcctcaagttgtggacgcaaccagtcacgacgacgcttgtaaatgtcacgcatttcatcagcaacttccgcagccgttgtcacggcaaccaacgcaccatcttgcaaaacctttggcaatgagaacgtcaacgcaccgtgcaccttttgggcgtagtcaatgaagctctttttaccaagaataaagccgatacggtatcccgtcatggcgtgtgactttgacaatcccgtaatcaaaatcgtttgatccggaatcaactttgccaatgatacgtgtttttgatcgtatgtcaattgtgagtagatttcgtctgaaatgacccataggcggtgcttcttgaacacttcagccaaggcaatcaattcatcttctgaatacgtcacacccgttggatttgatgggtagttaaacaagatggccttgactggcaccttggcattcgccatcgcttcatcaacctgttcaggcgtcaacttgaactttgttggacgcgtgttgattgaaatcttcgtcccatgggctaagtccaatgacgcaaagtatggtgggtatgccggttcgggcacgattacaccttcgttgtcgttcaacaatgtcaagaagacaacgttaatcgcttcagacacaccgatggtcacaatcatgttgtcttcgccatcatagttcaagtcgtacttcttgttgaagtattcaaccgctgcattacgcaactcacgctcaccttgtgactcggcatagtgtgaattgtcttcacgaactgattcaatgatgcgttccttaattgcgtcatcaacgttaaaaccaggctctccgaacgtcaaacgaaccaagtccggaatatcacgaacagccttttgaaaatccaacaacccatctggcgccaaattagttacaattgggttaaggggttggatgaaatcttttttaatcatattaattattctcacattcttcccaagtagtaattattataacaataatcacttacttttctagctgtgttttgtgaagaaaatatgaatgtcaaacaaaatgactcacagagggggctgtgctgatgcttgaatttactggaaatccaattgaaccacaacgcgatacttgggactggggcgaaattcgtgccataccgcttgatttgtcagatgaaaagctggtttcagtgagctatctacctgaaaaaatggtagttagtccacaatattttatccagcaactaccgggcgcgaaggctgatatcttcgtgcgcgaaacgattcaacaaaaattgaatgatgccgcagacatgctgccctacggctataagttggttatctttgacgcttggcgtgatatcgatacgcaacaagcattatttgatcgcatgcaaagcttcttgcaacgtgaccatcccgaattcaacgccgaccaaacgttggctgcgacgttgcgaattgtggccttgccttcatcaaacgcaaaccgcccttcaccacacaacacaggtggttcaatggacgtttcaattgttgatgaacgtggtcgcctgttggaaatgggcagtccatttgatgaaattagcgcccgtgctaagacaacttattacgagtttgaaccggaatctgaagacgtcatcaagattcgcgaaaaccgtcgtctgctttatcatgtgatgacgaatgctggtttcaccaactatctcgaagaatggtggcattacgactacggcaatcaaaattgggccttcatgagcggccacgacaccgccttttacggcgcgacaaaacctgaattcccttggctatagtaaaaccgacatcaccttcattggcgatgtcggtttttcattattctggcacaaattcgtccgcttcaacgtcttgaataaaatgcttcaagttataaaagaaaatttcagggtcatccaccatgtggacgtggccggcgtttggcgtcacacgcaaacgggcatttggcatcttgtcacgcatttgacacgctacttccaacggcattgattcgtgcccaccaaaggttaacaaggttggcgtttcgatttcgtgtagtcgatctgccactgaccagtgcgccaatttccccgtaatcacaaattcattgtcaccttgaaaatggttgtacactgctgtccccatcgtactgatttggtgatgcggtgcattcgggtggcgtgtgatgtattcacggtccaagtgtgtcgcatacttctgataggttgggttatcccattcgccacgttcttcaacttcgcgcataaaggctacgacatcggcgtcgaactccttttcgcgaatcgcattgatattcgtgacataatcatcaatgttatcaatcattgagatgataattagtcccttcaaaacgcccggatgacggagcgcatattcttgggcaagcaagccaccccacgagtgcccagcaagatagaactcaccatcttcataacccaacttttggcgaacttcttccacttcgtttaagtagtaatcgtaattcaaatacttttcaacgttggccggatcatcaaaatcaggttgatctgaataccaagccccaagttggtcatactgtgtcacttcaactccaattggattcaagaactctggaaaacgttcatatggctcatgtccagcccctggaccaccatgcaacgtcaacaacttgattggcttgcccgtcccatcggtgcgtgaccacaaatggtagccattatccaaactcaaaatatgtgtcccatcttttgtcataccgttttctcctaattctttactgcgttcttccaatcgaatgtgccaccaactggattgacgaagacacccttaacctttggattcatcaaagcggtcatctttgagtatgtcaacggcgctacagcaccttgcttttgtgcatactcttcagcggctgccaagtccttaaagcgtgccttctcatcgttagcatccgtcgtcgttgccttctcatagagcgcatcgtacttcctgtctgaccaaccagttaggttccaagatgcccccgttaccaacgtttgcaacatatcaactggatcagtgtaatccgcgttccacgttgccaatgacaagtcgaacttacccgccttttggagtgaactggtttgcttagctggcactgacttcactgaaaccgtcaagcccttcaagttcatttccaattgtgattgcaagtattgaccggtttgcttggctgcatcggtatcgtttgttaacaacgtcaacttcacttgcttttgaccaacttgcttcaatccttgttgccacaacttggctgcttgtgtcttgtcataactgacgtacttcgtgtgcgcaccaacggtgaagtccttgcccgtgttcggatcctttgccaaccccttggcggtaaaggtcttggctggttcagccgcccccgtcaacacattcttcgctagcttctcacggttaaccgcaaatgatagcgcctgacgaaccttcacgttttgcaacgccttattcttttggttcatcgtcatgtatgtcgtcgcagcggtatcaactaccgtgtaaccaggcttgttctttgagttacgggcttgcgtcgcattcaacaaagcgaaatccgtcttacctgagttgtataggttgaaactcgtcgttgcatcagccgttgtcgttacgttaacggccggcgtcttaacattggctgcatcccagtaatttgggttcttttcatacgtatatgatgaacttgaaccatcccacttcttcaagacatacggaccacttgaaagtgaatcaacagcggtcgtgccaaacttttgaccggtttgctcgacgaagctttgcttttcagggaagaagtacatcatcgccaactcagccttaaattgtggcaatgggcgttccaacgtcacttgtagtgttgtatcatcgagcgccttagcacccaattcattcaaatccgtgaccttacctgcttggatggcatcagcgttcttcaccccactgaagaacatcgccccgatagccgccgtcttaggatcattcgtacgttgccaactgtagacaaaatcttgggcggttaactttgacccatctgaccacttcaagttgtcacgcaacttgaaagtccacgtcaaactatcttgtgacacgtcggctgattgggcggccgccaattctggttgaccactcttaccaacacggtacaacccttcaccggttgccataacggcatcttgtgatgggatatccgcaacatttgaagggtccgtcgtctttagatcgcccgtaagtgtccaattgatggccttaccttcacttgctgaaacaactggtagcccagttcctgcgaccataaccaatgttgctgacatcaaaactgaattcttaacaaacttattcataaccatagctcctaatattcctgaatgacctacgagtaaaagtttgagctcaaaaaatttatataaaaaaacggctagtattctgcgcaaaatactagccgttactcgtttacaaagtaattaaatttggctagccatgataatcttccttgggaagcagtcatggctagcgttagcatctcaaaaagccaaccatcactgcgaaataataataataatcgcaatgataattggggcaaccaacgtcataacattcaacttttctactgacacgttcttcatgacgttgtcctcctcttttcttgatgttcttaagtatacgaggttaattataaaagtcaacacttttttctaatttaattttaatcaaacgttttgatggtggtttgtaggtggggcaacatgccgcatggccagcgctattcagataagcccacataggaccaaaaggattaggggaaattatttgccccgctgaatggcgtctgcgccattcggttgccccagtttgaactttgccggagatagtccccagccctcatgcctcgacgcaacgcgtcgacactcaccaccaaacaaaaaaacacccagaaaaaatctgagtgcttcatgtgttgattattcaactgttgtgctgatttcgttgatccactcagtcataactgggtagtcattgccttcaccttctgcaatacgagctggcaatactgaacctagatagtgttgcgccaacaattgtgacaacaccaacccaccaattacatcaaggatgtacgtgtcgttcaaggtgcggaacgtcaatacgttgtccgtgttgcgcgcaatgtgaaaacgatcaatagcaaaattgattgtcttggcaacatccccaatcccactaactgttgagctggcggtatcgaaggcgtttagttcggcttgcaacacatcttgccagttggccaatggcacttggcgtggttgctcgcgttgaatatctgctagtgataatgacatgttcagttccacctaaatttaataattactactcattatagactaaccactaacatttcgtcattaatatcccttatgcgaacttttcagcagaaccttcaggcacgcgcaccaagtccaaggcaactaagcgttcggcgatttgcaccgcgttccaagccgcccccttcaacaagttatctgacacaacccacatgtggtagctaccgtcattttcaaggtctggacgcacacgaccgacaaaggtgtcacgcttgccttcagcattgattggttgtgggtaaatttggttggctggatcatcttccaacacaacacctggtgcttctgacagggcttgttgaatctttggtgttgaagcgccgtctgcgtcagcgacttcaaagtaaaccgtctcaccgtgaccaactgggactggcacacgaactgcggttgccgtcaccttgatatccttggcattcttgtcgcccaacataatcttcttcgtttcgtgaatcatcttgtactcttcgtgcgtgtagccttcatcttcaaacacatcgatttgtggcaacaagttgaaggccaatgggtagtgcttcttatcaccctttactggcaaaatttcggccgtttctggttcaccattcaagtgctgttgcgcttggtcgagcaactcttgccaagctgattgaccagccccagaagccgcttgatacgttgacacaatcacttgcttcaaaccaaattgttggcgaattggctcaagggccaccaccatttgaatcgttgagcaattagggttcgcaataatcccattgtgttcatacaacgcttgttcgttaacttcaggcacaaccaacggtacattgtcgttcctgcgccagaatgaggtattgtcgacggcaaccgccccgcgctttactgcttctggcaacagacgagctgatacggaaccaccagctgatgccaataccaagtcgaccccttcaaatgactctggttgggcctcttcaatcgtaattgtttcaccacggaactcacgcgtttggccagctgaacgcgctgatgccaacaacttcaatgacgccaccggaattgatgattgcgccaattgttcaattaaaaaagaccccactgcgccggtagcccccaagatagcaactgtatatgatcgttcttcactcatgtgttttctcctcaaattttaataaaaacccgaaaattgggtacattaaaagcacaagccgaaaatgaccggttgtgcttccaaaaattaaattgttctcattttatgttagcccttcaaagcaacgtattgcttcaaacggttaacagcttccgttaggtcttcggttgaagtagcgtatgacaaacgcacatagccttcaccaccggcaccaaagattgaacctggtgcaatacccaacttcactgcttctgccaaatcaatgacaaattccatatcgttcgtgttcaacgttgctggaatcttggcaaagatatagaaggccccacctggttgtgcggccgtaaagccagcttctgccaacccagccatgaccaagtcacgacgttgcttatacgtatcacgcatatcaatggcgtcttgacgaccattgcgcaacgcctcttcagcagcggccatcattggaccaggtgccgttgtgaccaagaattggtgcatcttaccaacgtgcgccatcaacgtagctggacctgctacatacccaatacggtatcctgtcatagcgtgagactttgacaaaccgctaatcaaaatcgtttgatctggtagcaatgatgccattgaaacgtgctcaccatcgtaaaccaactcagcgtaaatctcatctgagaagaccaacatgttgtgagcctttagaattgcggcgattgcctcgatttgctcagctgagtacgtcacgccagttgggtttgatgggtagttaaacaagatagccgtggcatctgggttttcagccagcgttgcttccaacttttctggcgtcaacacaaaatcaggtgctgtgttaatgcccacaacatcaagaccgataatgtcagcaatcgcttcatacattgggaatgttggcgttgggataataatcttctcccccgcgttcaacaagccattcatcgttgcaaacaatgcttctgaagcaccaaccgtcacgacaacttcaccgtttgggttgtaacgtggcgcatcaaaacgctccactaagtaatcagaaattgcctcacgcaagctcaagtgaccgtgtggtgcggcgtagtgtgaatcatcagcatcaatagcagccttcgtagcagccttaatgtgatcaggtaccgcaaaatcaggctcacctagtgtcaacttgatgatgccatcaatggctgaaaacttttgatcaatcacacggattggtgatggcaaaatcttggcaagctccttgttataacggtttgcaagggctggatttacttctggcatttcagtctcctttggctctcaggccattcttttttcttaagcctcgctggacttgggcaacaattacaataggtgttctagaccgactaccagcccatcgatttgatgaacctgacgaatagctaacgcaacgccccccataaatgatgtgcgtgtaaatgacgtttgcttcaaacgtagtgtttcacctggcgcaccgaaaatcacttcttcttcggcaacatagcctggcaaacgaacggcgtgcacgggcacgttatcaatgacttcaccacgtgctgcatcatgttggcgttgtgccaccggttcagcttcacgggcagctgcaatttttgtagccgtcgctttggccgtaccagatggtgcatccaacttatgcggattgtgaatctcgataatttcagcatccggcatatacttggctgcctgctcagcaaattgcatgagcaaaacagctgacaatgagaagtttggcacaataatcgcatgacgattatacttctgtgccaagtgtcccaattgcgtcacgtcttcagcggacaacccgctggtaccaacaaccaaatcataaccatgggacaatgcataagtcgcgttatcaaaggctgattctggttgcgtcacatccacccaaacatcggctggtgtatcgatctcgtccagttcagtatacacggaaatgggactttcatgaagcgttgctgagagaattcccactaattctaaatcgggttgttcagcgatgagcgactggatttccagccccatcttgccaaagccaccagctaataaaactgttgtcatgtttaatcgtccttttcattaagtgtcgcttgcacatccgccaattcaacgtccgttaatggcaaaattggcaaacgcgttgtgttttcaatttcaccgcgttgcgccaagatcgctttaactggcgctggggatgggtaacggaagaatgcgttcatgcgtggcgttaaccaacgttgcaaacgtcctgctgtttcgatagtaccgtccgcaaccgccgcaaacaagtccgccatttcgcgactatatacatgcgcagcaactgaaatggttcccgttgcaccaaccactttcgcagccaacgtctgtgcgtcctctccggtgtagaccgcaaaatcggccggtgtgtgaccaaccaagaatgccaaatcatcaatcgtggtgacttgcttaactgcgttgatcattgggtgttgggccaacgtcacgacagattcgttcgttagtccaaccgctgaacgacccggaatgttgtacaacatcactggcacacttgaggcgtcagcaattgccgtaaagtgagcaatcatccccgcctgacttggcttattgtaataaggcgtcactgccaacaaagcatcgacaccaggaatggcgctgacttccttcgccagcgccactgaatgcgctgtgttattgtcaccaacgttagccacaaccacaccgcgatttccaatgtgggcggcgaaatgcgtgtataacgcgattttttcatcgtgcgttagggttggtgactcgccagttgttcccccaataacaaaaccttgcgtcccctcatgcaacaaccgatctgctagtcggtctaagtccacataatcaatttggtcattcgccgtaaatggcgtaataattgcggtaattaattcaatattttcgtacatcgctcttcccctaatgcgccatgcgccatgttaagtaacccgttattgcatccacgcccggttgaatagccgcctcgtttggcgacaagccagcttcatgcaaactgtgggtggcatcatcaacaccaagccagaacatggtccccggaatttggtgtaataaataaccaaaatcttcccccgtcatagctggcgcgatatccgtgtaatcaacgtcaggtgcgttggtcatataatcaataaataattgcgttgtagttggatcgttttcaactggtaaatagccgccttggattaatgacaaatccgcagtcacaccatacatcgtttcgatgccggcaacgatgtcgcgcacgcattgctgcatcatttcaatgtccgtttggcggaacgcacgaatcgtgccatccagatgcgccgtttcggcgattacattgccaatcgttccagcgtggaaagtgcccagcgtgacgaccccgccacgaaccggatcaacattgcgtgacacaatcgtctgaattgctgagacaaatgctgcccctgctacaatcgcatcggtcgcttgatgtggaaacgcggcgtgcccacctcgtccagtaaacgtgacatggatttccgtcgttccggcaaacagcgtgcctatgtgactggcaatttgaccagctggcaacccaggatggtcatgcaagccgtagaattcatcaggtcgccagtctcccgtaaaggctcccgtttcataaacccgtcgtccaccataatccgactcttcagccggttgaaagaagaaaatcaaattatcttttggttgatgcgtggcaaagtttgccaaaacacctagccccactgtcatatgcatgtcatggccacaggcgtgcatcacaccttcatttgttgaggcaaacggcaatcccgtcgcttcggtgattggcaaggcatcgatatcggcgcgatacccaatggtgcgcgtcggatttgtaccagccaagcgcaccaacaacgctgttggcacctcaggaatttctcgaatcgtcatgaagtccgttttgaacgtttcaaccacgtttttcaaatacgcatgcgtttgcgtttcgtgtaaggctagttcggggattttatgcaaatcacgtcgaattttgattaaatctagtgtcgtcatatgctgcccctgtttcattaatctaagttacgcaacgcatcaactagtgctgtcttggcactggtttgtgcatcaatttccttgataacacgcgccggtacaccagctaccactgtgttcgcagggacatccttcgtgacaatcgcaccggccgcaaccaccgcattatcacctacttgaaccccttcgattaccaccgcattcgcgccaatcaacacattgtcaccgatgcgcaccggttgtgctgaagcgggttcaaccactccggccagtacggcaccggcacccacgtgactgtgagcgccaacaatggcacggccacctagcacagctcccatatcaatcatggttcctggtccaatttcagcgccgatgttaataatggcacccatcataatgacggcgttcgcgccaatttcgacttgatcacgaatgatggcgccgggttcaatacgggctgggacaccatcgtaatttagcaatggcacacccgagttacgggccaacaattccacgtgttggttcgtgatttgatcggcatgtgctgccaaaaccggtgcgatttcgttaaagtcaccgatcaccgttcctgtgcgtgtttcaatgaatgcctggactgtttctggccaaacaatatccgtcaaatcgcctgccaacgtcacgcgcgctggtgtttgcttaggtgcgtttgcaataaaattaatgattgattgtgcgtctaattctgccatgctgtttcctctttcttcctataagtagtggcgatctagtcgcacgatatcttggtagctttctcgttcaacaaccacctttgcttcaccattttcaacgaagaccacggccgggcgtggattgcggttgtagtttgatgccattgagtaaccatatgcaccggttgccaaaacagcgaggacatccccagccttcgtctttggcaacgcctgctcccaaaccagcacatcccctgattcacagtacttgccagcaacgcgcacgacttcttcagctggtgcttctggttggttaaccaaaaccgcctcatactttgcttggtacaatgccgggcgaatgttatcacccattccaccatcaacagccagatatgaacgaatgcctggcacatctttacgcgagccaattgtgtacaagctcacccctgctggcccaacaattgaacgccctggttcaatccaaacagccggcattggcatcccatattcggtcgtcttttcagcaatcgtatcgataattgctgccacgaaatcagatgccggaattggttcgtcatcttccgtgtagcgaataccaaagccaccaccagtgttgataaccttaggattgaagccccattcatggaccaaatcaaccagctttgtggctgccatttggaaaccagtcacatcaaagatttgtgatccgatgtgtgcgtgaacccctaacacattgaagtgtggatcggccaacgcttcttgcaatgccgcttgcgcttgaccgctatttacatcaaagccaaacttactatccgtttgccctgtggaaatataatcgtgcgtgtgcgcctcaacacctggcgtaatccgtaataggatgttttgcacacggtcacgttcagccaacaaatcatgaagcaaatgcaattcgaagaagttgtcgacaataatcgtacccagattgttctcaatcgccatcacaagttcttcttcagacttgttattaccattgaaagagacatcgctcattgggaagtttgcttcaagggccgtgtaaatctcaccacctgaaaccacatcaatgtgcatcccttcttgggcagccacctcatacattgcaaccgttgcaaaggcctttgaagcgtatgagacagcataatcaacttggcgttctgtaaagacgcgcttgaaatcacgcatctgttggcgcatcgctgacacatcgtaggcatacaaaggtgtgccaaatcgtgctgctaattcgtttgcttctacaccgccaaccgtcaaatggccggcagcatttgtttcatatggtgttgtcatcttatttcccctactaatctgtaatttgacgataaatgcgttcttgtaagccagttgaaatttcccaaggtgccaatcctacataatcagcgacatcctcaaggcggttttcaacatcaccttggcgaccaataatggttaccgtcgtgccaattggtaattcaccaggcaatgaaatcatcatctgatccatagctagctttccaacaattggtcgacgctcgccgtttacaatcacttcgaatccctgcattttacgtggtaacccatcaccgtaaccaaccggcaccgtaccaatccattcaccttcttcggtgtagtacgtgtgaccgtagctaacaccttcacccttgtggcaacgcttaacgaataccaactctgtttcaagtgtcatcaccggttctaagtaatcatcatcacgcagctcaccaagcgatggctcaaccccgtagaccaccgtaccagcgcgaatcacatctgttggcatttcatcagcgtgatacatggcggcccctgagttggcgagatgcaccaacggtggcattggtagcccatccgttagtgcatgccagcaatgcaattgttgatggaagtaatcttcctccgtcgaatccgcttcagagaaatgcgtcatgatgctttgataatcaaaaatgtcatcatgggccttcaagtaggcaatcgccgtttccaacgtggcacgttcacggaagccaatgcgtcccatgccagtatctaccgccaaatttacttgcaggcgtggaccatcgggactcaagtactcagctgccgtttccaaccaagcgagtgaaccaaccgtcgccatcacttggttatcagccaataactttgcgtattgtggcaacgtaatgcccaacaccaaaatcggtgcggtaatccccgcttgacgtaatgccaaaccttcatccaaaactgcgacggccaaaccatttacgccacccgctaaggccgcttgactcatgggcaccaacccaaaaccataagcattggccttcactgccaaaaagacgaaactcgcttgggcactttcacgaacttgttggacgttatgtgtgaccgcagcttgcgaaatattaagacgtgtcggacgtgtgactgctactaccatgatgctttcctctttttctttagtgtccgtcgggcaaataaaaaacgatcaaccgacggcactatcgcactgtcagttgatcgctcgaaaaagcattcaaatagactgttacgatagctctccgctgatttccagcgacagtccaacagctcttaactgttgtcccaacaaattagttgcgctaattcatttcggcgaccgcccctttcacttaacgtccttgccggtgccggctcggttaagctactcttgttggtcgcaacctctatcaataattaagatacgattagaatactccttataattatgagtgtcaagggttgacttttgagaacttttctttttaaattatcgtcaattagccattatttgaaggagtcaaacatgaaagttgtaaaatttggcggatcctcccttgcgaacggaccgcaactagaaaaggttttgaatattatgttggccgatacagaccgcaaagtccttgttgtatcagcgccaggtaagcgtttcaaagaagatatcaaagtcactgatttattaaagacatacgcgcagctgacaattgttggcgaagacacgaccgatattcaaacgcagattttacaacgctatcgtgacatcgttacttattttgaattagaagaaaatgagattctatcttcattatctgatcaattggcacagttgagccgcgttcactacccctcattcgactacttatatgcagctttcatgggtcatggtgaatatttgaatgcgcaattagttgcctacgtcctccgcgagctcggtcatcccgctcaatttgtgtcgccacatgatcttggtttgacagtttctggttcaccaatggcggcccgcgttaacgaagatagttacgaccgcatcgccacatttaatctacctagcgaaggtttgattgtggtacctggctttcttgcctataccactgacggtttgatggcgacattcagtcgtggtggttctgatatcaccggggccatcctggcgcgtggcttccacgcagatatgtacgaaaactttactgatgtgtcagctatctacgccgttgacccacatatcatcaagtcaccagctgcgattgaaacaatgacctaccgtgagatgcgtgaattagcctacgctggtttcgccgtcttccacgatgaagccatcattccggttatcgaggcagatataccaattaatgtgaagaacacgaatgaacccgatgcaccagggacgatgattgtgccggtggatcaagtttctaaccctgcgaaagtcactgggattgccagcgatgatcgtttcgctgcgttgtaccttcaccgctacttgctcaacaaggaagttggtttcacgctacgtatcctgcaaatcttggctcgccacggcgttagttatgaacacatgccatcaggtatcgatgacatgacgattatctttgataaaacacagctcacccaaccaattcaagatgctatttgcgcggaaatccaggccgaaatcgcgccggaccatctcgaatggattgatgatttcgcgattatcatggtggttggcgaaggtatgcaaaatcgggttggcgcattttcagaaatcgcaacacccctttctgaagccggcattacgttgcccatgatcaaccaaggtgcctcacaaatttcattgatgcttggtgtgaaagccagccaagtcaacgacgccgtccgcgttatctacgacgccgtcttctaaataacaacaaaaaaccgagaacctgtttaaaacagattctcggtttttatttgtgattaaaattgattcttcgcgtaattacgcaacgttgcttctagacctgcgttgcgggcagctgggcgaacatccaatgcttcatgaatttcaccaccttgaccagcataattagctgactccgtgttggcaatcatttgcaactcatcaagtgagtacgcgttatgatcttgcacgaaacgtactgccccatctgcaacaaccacttgatgcgcttcaagcggttgccacaatgacacaatctgatcagctgaatcgaaaatcaattcaacgtgataatcaggtgtgaccaccttcacgtttgattgatccgctacgccacgattatgtaggctaacacctgggtgtagcacctcgtgacccatctcttcaagcacctttgcctcatacatggcacgtgtccagccttgggcacgtacaaaatcagacaccggcttgccaagatagtagcgcaattggttgtcgaacgttgccgttaacaaacgactcgttgcataacgagagcgaataccgttccaagcacggtacttcaaacgcatcaagtaagcaacacggttaacaaattgccaataagcttgtagttcatcttcatcattaatttgtaggtagtataaattaggcgtcgcttcacgatcgtcccaaagacccaaatgtgtcatttgcacaaagttggtgtcatctagatatagccccaaaacgttgtacaacatccccaaacggtcagttgctggcgcgctaccacggtggaaaccggctactaacatttctgtaaagagctctgatcccactctgtgtgcttcaaaccacttggcttccaatacgtccatcatcgtcgcatcgtttagctcaggtgccttcgcaacggcctcaacatatgctgccaaagacttaggtaaccagccatcagccatcaatgtctcaacttgccctatcaaagctgctgacattgctgccttatgttcggttactccggtcggattcgctattaaatcgcgtgttcgcttaaacaaaattgtcatggcgcacctcctcagagtactagcttaccataattaagctaatggtgcagtcgactcgcgcacaaccaagtttgcatcaaaggctgaaacttgtcgtggcgcgtcgggttccgcaatacgcttaagcactgagtccaatgctgccttggcgatatcccagactggttgttcaattgtcgtcaacgctgggcggaagaactctgcataatcagtatcatcatacccgatgactgacatttgttctggcaccttgatgccgattgcattcaagccagagatgaccccaatcgccaactcatcattcaaggcaaaagctgccgtggcgtgcgtgactgagacagccatcgccgccgcacgacccgcgtgcttggtcaaattacgcgtcgccacttcactgaccttcacacctgcttcggccatcgtttccttgaaactagccgtacggtattgcaaattatctgtgtaaacttggtttcccaacaacaccacgtgcttgtgccccaatgcaatcaagtgttctgctgccttgcgaccgccttgcgtatctgatgcataaacggcatccgcatcttccaattcatcgtggttttcaagcacaaccatggcaatgccacggcggcgcaagctacgcgcaacggcaggtggattagacaattgactcgccacaaccaaaccttgtgctcccgcagccaccaatgtttcaaccgtttgatcagccgtgctggtttccgctgtcatgatttgcaatgacacattttctggcaacacctcttgcatacgttgcacgatgtcaccgaaataaggattgcgcaaacttggcacaatcactccaatcattgtcgtcgtgccacgcttcaaactacgggcactggcgtttggtacgtaaccaacctcgtcacgtgcagccaacaccttttgtttcgtggcgtctgagaatcgttctcccttgccatttagtacttgtgacactgttgcaattgaaacccccgccaaattagcaacgtcacggattgaagccttccccattattccttctccttcttaaaacactgttaacccagttcctgcaatatcaaccactttaaattcacctggcaaatccaaataagccagcacatctaacaaatcttgggtttggtttggtgcgaccaacgtcaccaccgctggtccatcacctgcaaccactgatccgtagacatcaagggcatgtgatgcttggcgaatcttgcccaactctggcacgtcattaatcactgcccgttggatattatcggtttccaacaattgtccagccaacaccaattgttgtgactgccaagcagccaacaacatatttccggcagctgccgttgcggttgcatccgctaaggcaatctcgttgggcttgtccgccttgtcgtcacgttggtactcaggcaagtagataactgcttggtattccggtgcaaccaccccgctggcaaaaacgttaccgtcgtttaagtagctggctgtgacaccaccaagtaatgcagctgtgacattagctggttggccttccgtacgggcagccaacgtcaacttcgtgtagtcatctaggccgagttcaccaagttggttggccaattcaatcgccgccaaaagtgccgccgttgatgatcccaaaccttggcgcaatggaatatctgacgtcacgcgcaacacatgtggcgtaatatctggatacaacttcttggcaaccgccacaatgtaattcgtctcatcataaggaatcgtatcccctagattgtgttcaaccacccaaacattgcttgcttcaatgatttcgaccgttaatgataggtctagcgcaatgcctagtgacgcgaccccaggtccaaaattgcctaacgttgcaggtaccttaattgttatcatgattaatctctttccgggttaaatactgttgtaaaaattttaccaacttttgaaaggttttacagccccttattgcgacttatgttcacaaattgaccaacaattcgcaaattagttgcctctatcaattaatattgttcgtatattccgaacgataaaacgttttaacatttttctttcgttgttaaacattttactttggtcaatttaataactttttgtatccctttcagccaagttgttctacaatagaactcgtaatagaaatgcagggtagattttgatgcgttaagtgctgtggaaacggaatgtgggccacagacgaaggactgatacgttcgcgatatcattatcacattcactgtaataggtgaaaccctccaaataaaattaggaggtgttttcgatatgaagacattaagttacgcattgccacgtttgcgcacgacgcagttggcactactaggaattttgatggcgttggaaatcgtcatcggccgttttacgtttggaccagcttccgttaaggttggctttacgtttatcgttgttgggttgattgccaagtggtacggcccttattggggaatgattgttgcattcttcaacgattttatttcaacgatgattagtggttatagttatttctggggattcgccctttcagcgctagtcggggctgctatctacggattctcattctataatcgcgagcacatcagctgggcccgtgtgattattacggttattctggtcttgtttattgtcaatgccgttatgaatacgctatggattgtgattatggggggtatgactgatccgcacgcaatcacgtcactcctttgggtacgtggtgtgaagcaagttatcttcctaccaattcaagcaattatcctttatttcttcttgaaccaccccgttcttgaacaaatgaagtcacgtctgatgatgaagtaattaataaagaggattcgacaatcgtcgaatcctctttttgtgtgctttagaaactttgatgaacagacaaaccttgttcaacgcaagccgtctcaaatgaattggcgaacttattgcgttcatccggtgtgctgaactttaacttgaatgcgttctcgattgtgtcacaaccaatatgatagacacaactgtcataaacgcgtccaacgaatacctgtcgcttgccatagccagattgcttaacagctgagtaaacgaataatgccgtttgctgcgggatttcgcgagcactgtctaatagtgcccacagcttttgttccccgtgtagcttgtttttttggtgaaattcctcttcgtgcatgtctgcctccaaaacttcgaacctggtggtgataccaccagtgcgctatcaacaaatcaagcatatcccgtattttattttttgacaaatcacctttatgtttttaaaggacttaacttttatatccgtaacatcatgttataattaatccactaaacaaatttaagcgtaaaagggaatttcattatgagcgaatccgtatcaaagacgcagtatctgcaaacgattttagaattaagtggcggtgatgacgacagcaagatttcaaacaatcaaattgccgatcacttgaacgtcacgccttcttccgtttcaaacatgttggcgaagttgcaagaagccggcgaagttgatgtcgtgccttattacggtgttacgttgaccgaaccaggtcgtcaaactgcccttcgtttgattcgttcacaccgtttgattgaaacgttcggcgcaaccaagctggggctttcaatttctgaagcccacttcaacgctgacaacttggaccacgatgcggacgatgaatttgttaacgcccttgaaaagtttttggattatccaaaatattcaccccacgggttgctaattccggacgcaaattacaactatgaaccagacaagttgcgcacgttgcgtgcagctaatgacggcgaaaccgtaacgctaaacagttttaccgaagacttggagttactccaatatgttgagacagttggtgtaacccttggtagcacatggacaatcaaggaacgtttgccattcgatggccctcttgttttgacggacggacaaaacgaggtgcaaattacgcaacacgctgctgattttatttatattaacaactaacgacaaaaagccattggcaccaaatacggcgccaatggctttttttgagtcgttacttaatccaacggttatccgtagtgaatgccttttgaatgtcttttggcgtttctgcccaagtctttaccccttgtagctcaccacgcatcataatacggccacgttcggccgtgtaatcacacgtgatcaacgtgaccagcttcttaccttcaactgggtaaacccaatcgacatcggttggctgaatcaccttgaagtccactgctttgtagcgataaaccttgttcatatcagtcagataaatgtcttggcccacttttcctttgtagtaaagtggcgagaacagcaaatcacggcctgagtcacctggaataaagtgagaagctaaggcataattgccttcccccatcacttcatcaggaaacatcgtcccagcacctagcgacaagtttaaatcagtcgtaccgtttgaaattggtaccgaaataccaacttccggcacagcgacaaagccaataaaattaatcttgtctgaattcaagcgcgcttgtagcacctgctgcgctgttaaagcgcccactttctgccaatcgtagttcgcctgttccttttctttctgcccggacttgatcgattgctttgtaacttgtggttcgaatgactttaacgtaaagttggcaatctcgttatgaaaaatcaagcccaacgaaattatcaaaatcagtagtacacccagccatttcagccatgcgaatttcttcttctttttcttttcactcatatcaacgtcacccctcgttaatttactgatatcgtaccaccaaattaataaaaaaatgggcctccgatatgaatatatcggggaccattttacaaacagtcgtgatggttaggcacgcctatttgaggcgttatcattttagaggtcttagacaataataacgtctgtaacatatgaaaaatgctaagtatgaactacttaacatatatcattctaccaaaacgactttcacaaagtaagcgttatcatgtttcaaaatgaaataaaaagccacccaggaatgggtgacttctcgtgtcattattcagcctctgaagcgccaaagttattgatgaagtacaacaacgtttgcaattcgttcgtcaaatcaacgttttgtacgcggacgtcactaggcacatccaaacgcaatggcgtgaagttcaaaattccgtgtacaccggccttagccaaacggttagccaattcttgggcaactggtgctggaaccgtcaaaatggccacatcaatgcgttggtcagaaatttgcttctccaaatcgtccatgctgtatacagggacaccagcttgaatcgtgttcacgatatcttcgttaatatcaaaagctgcagaaatgcgggcgtttgagctttggtggaagttaaagttcaacaaagcttgtcccaaattaccaactccgacaagggcaactgatgccaaagtgtcttggttcaaaatttcaccgaagaacgtcatcaatgccttaacgtcgtacccgtaaccacgctttcccaatgcaccaaagtatgagaaatcacgacgaatcgtcgcagcatcaaacttaacagcatcagacaattcgtttgatgaaacgcgagtcgtccccgcatccaacaaaagcttcaagtaacggtaataaattggcaaacgcttagcggtcgcgcgggggatgtcatgttctgccatgtcaacctacctcattttctaaaaaattttattttcatgctatttcacaaacaaaaaaacgtttgtgaactctctatccttatttatagtaacacattccctgctctatgtgaactaaataacaatacattttcacaaacttagagcaaaaagaaagaccactatttccgaaatagcggtctaaatgcctagttttcgccgtttttacgctttggcttacccttatttttactgtgcttacgcttagcttttttctcttttgcgaagcgatctgtacgcgccacaacttcttcagccttcttcttttggaccttacgcacctttgcaaccggacgtggcttatcagccgtttccttgtttgcacctggctctaccgtatgaccagctgaccctgagaatgacgttggcttcgttgcttgactagcaccgttaaccaattgaatatcaacagccaccaaacgacgcaaatcacgcaaatcgtgatcatttccaaatgaaataaccaaaccatgcttgcccatacgacccgtacggccggcacggtgtgtataagtttcaccgttacgtggcaaatcaaagttgataaccgctggcaagtcaggaatatccaaaccacgcgcagccacatcagtcgtcaacaagaactttgccgtgcccttacggaagttttccaatgacttggcgcgcgttgaacttgaatcaccacggaccaatgtcgccattgctacgtgttcgtgcgccaagaaactagccgtcaccttcaattgcttggtcgtgttaaagaacacaatcgcttggaagttcttgcgcgctgccaattggcgtaagcgcttgttgcgttgctcgcgggcagttggccagaattcgtgggcaattgccgttggaattgggacattacgttggtcaatacgcgtaaagtcgcgatcgaacaaaccagccgcgattgtcgtatctacttctgtcgccccaaataaagcaacttgtatatcagggtcgtcaatagcgtcccatacgccgtcaatttgcttagcagtatcttcagtcaacaattcgtctgcttcgtccaaaagtaacgtacgcaaacgcttcaacttcaacttaccattgtcgaccaattcagcaacacgacctggtgttccaacaatcacttctgggtgcttcttcaaggcatctagttgacgcttcacgttcgcgccaccagtcaaagccaacaccttcaagtccaccaaagttgcccattcacgtacaacacgggtcgtttgcatggccaattcttgtgatggtgccaagattagcaattgttcaccatcccccggtaccaacgttggcaacaatggccacgtaaaggccaaagtctttccagttccagttggtgccaaggcatcgattgattcaccagcagccaatggttcagctacggcttcttgaattggcgttagcgtggtaaacccaacactagccaatcgctcttcaaaacgagtatccattttctatcctcattcaatttctttcattgtctttctaattgtaacagaaaagcgccccacaaaacgtgcgacgcttatcattcgttcattttacttatcagctgggaaaacaattcctgcgtcttgacgcaagtttgtcatcacaatgttaacgcgttggctcaatgtcaacaattgacggtattcttcatcgttagcaactggatcattgataatcttagcgaagacgctcatttcagccaccattgggttaccagggaattcttcgctcaagactgtgtcgttgccttgaccatccttgtacgtgacttcatgcaactctgcaatgttgtcgatgacaatagtgtcacgcaacccaagaatttcagacgtcaaatagctgttggcacccttaccgaattgcactgtcacatcaaagtcagcataacgcaaaatagcgataccacgtccatcagccccattacgcaatggcgttgcgaagtagtggctttccttcggcataccgaacaaggcaatcgctgcataaagtggataaacacccaagtcggtcaacgcaccggcactaaactcacgcgtcaacacgttcggctcctcacccgccaagtacgcatcaaagcgtgaagagtacttctcatagaccagtgtcgcaccagaaatgtggtccatttcaccaatcttcttcgcaattgccttaaagtttggttggtgaatgtggcgtgcagcctcaaacaaacgcacatttgggtgctcacgaagcaatgagtacaccgcttcgtactccttcgtgtttgaaaaggctgacttttcaacaatcacgtgtaactcgtgttcgatggcttgtacaacttggtcatagtgcaggctgtttggtgaagcgatgtaaaccacttcgataccactgttgtagaaatctgccaaatcagtaaacacagggacatccccgaaatcagcggcaaaggctgccccagtttcagcacggcgtgagtatacggctgctagttcatagtcattagattcatgcgcggcctcaaccagcatcttggtaatccagtttgtaccaattacacctaactttagtgtcatttccatatccctcgtttcctaaaagcgctttcaataatacttttattataccttgcaccaccaaaaaagcccaccaaacagttaaacagtcggcgagcttcttcgggttatcgatttaattttttagtgattagtccttaacgaacacagtgattgattcaatgtgcgtcgtttgtgggaattggtcgattggttgaacaggtccctcaatgtggtaaccgttctccaaaatgtgaaccgtgtcacgtgccaaagttgcagggttgcagctaatgtacacgaacttttctggttccatgccagttgcggcgtcaatcaattctggcgtcaatcccttacgaggaggatcaacgaagatgacgtctggtcgcataccagcatcgtgccactcaaccatcttctcttcggccttacccaattcgaacttggcattcgtcacaccgttgatgtcggcgttacgcttggcgtcgtcaacggcaccaggtacgatttcgacacccaagacagacttaacgcggtcagcaatcgtcaatgaaatcgttccgatacctgagtaggcgtcgataacttcttcatcaccattcaagccagccttgtcagcagccaattggtacaacgtttccgtcgtttgtgggttaacttggtagaatgagtttggtccgatggcaaacttcttaccgaacaacgtgtcagtgatgacattctttccccaaagggtgttgttcttctcgcccaagataacgtttgtcttttcttggttaacgttttggatgattgacttaatttcaggcaaagcttcgcgaatttcttcaacaatcatctctgcgcctggcaacttctttgaacgtgttaccaaaacaaccatcatttcgtggctgtagtaaccgcgacgcaccatgatgttacggataacaccagtgtgctcaaattcgttgtaggctggaatgtggtacttacgcaaaatatcacggataaccacgatagccttgtcaatttcaggatcttgaatgtagaaatcctcaattggcatcaagttgtgtgaaccacgacggaagaatccagtcgtcaattcaccacgcaattcacgcgtaggaatttgcgccttgttacggtacccagttgggttctccataccaagtgtctcagaaacttcaacatcaacgtgttgcttcttgaacaattcttggatttggttttgcttgaaacgcaattgtgcatcgtacttcaagtgagccaaaggtgcaattcctgtcgtcaacgttgcgacgtcaacatccttgttgcggtcctctgattccttcaacgtcttcacaacacgtccgaatgcgtacgttccagcaaccttcgtaatgccgacacggatttcttcacccggaacagcatttgggacgaaaattgggaaatcatcaaccttaacgactccgttaccttcgtacgttaaatcgatgaccgttgcgtcaaattcttggttcttcaccactggcgctttctttttcatcttaatctccttttgttggccttttcgacgaccatgttacctgtccattgtaacacagttaaattgtaagtttcatgagacgcccgtgagagttttgacaaaaacacccgcgtcatgcagttttgcacgacgcgggtgttgtgttttacatattgcgtaaagcttcgatacgcttttccattggtgggtgcgtggcaaacaagttcgccatcttatccccctttaatgggttcgcgatatacaatgctgaactttctggtgaaacgttggcttctgacatcggctcactttgcgaaatcttcgtaagggcattaatcaacccttgtggattacgcgtcaattcaaccgccccagcgtcagccaaatactcacggttacgtgaaatcgccaattgcaccaacgtggcagccaatggtgccaacatcaggacaagcaatgacacaatcatgccgattgcgttaccgccaccttcacgatcacgactacggttaccaccaaagtaccagaagtgcgttcctagattggctagcaacgcaattgcagacgtcatcgccacagcaatcgtttgcaaacggatgtcgtagttacgaacgtgggtcatctcgtgagccatgacaccctcaagttcttcacggttcaagcgttgcaagatacccgtagtggctgcaaccgctgcgtgttctggattgtttcccgtcgcaaacgcattcggactcggatcattgatgataaagacacgtggcatcggcacttgcgccaccatcgccatgtcttcaacgatgtgccacaaatcaggcgcctcatcagcgctctttatttcacgggcgtggttcattgacatgacaacgtcagtcgattgaccaaccatgtagaccgtgtaaaccaaaccgaccacgaaggcaatcacgattccctgttgccagtgtccattcatcaggaaagttcccaatgcagctccgacaccccccataaataggaagaatccaaagaaaagcatcactgttttacgcttgtttttggcaatttggtcaaataacatctgcgtttaaacctcgattacattccttgatcgtcaaatgaaaccttaacaacctgcttctcttcttcaggcgtctccaagaattcgcttggttggaagtggtgaatcccagcgatgatgttcgttgggaaagtttgcaacttggcgttgtagttcgctgtcgttgtgttgaacaattgacgtgagtaagcaatcttgttttcagtgttcgtcaactcatccatcaacttgttgtattgggttgatgccttcaagtctgggtaagcttccgcaaccgcaaagactgacttcaagctcgtcgtcaattggtcagaaatttccatggcttgttggtggtcgccagatggcacttgcgtcaaagcgttacgcaatgacacaaccttctccagcgtaccttgttcgaacttggcataacccttaaccgtttccaacaagttcggaatcaaatcgttacgacgcttcaattgcacatcaatttggctccaagcctcttgtgtgtgcatacgcgccttaaccaagccgttgtagatgctgatccaaatcaaaccaatcacgactacaaccgcgataataatgataattgtcatgtatgttgccccctattaaattgtttttatgacatattttaatgctaatttcattttaccagaaataagttggtatatcaggtaaatcaaatttgggcaaagaaagcttgcgtaaattcatagcggtcttttagccagctcgtgttattacgtgttggatgtactcggttcgtcaaaacgaccatcccctgcattgtgcggtaattcactgccataatcgtgcccgtgaagcccgtttgatacaaccaatccgtgaccacaaccgggttatcttccccaccatacgtccagtaatgccaaccaaacgtgcgaatcccggcctggttgtccttaagataagcgtgcatatcagctggcaaatcttcatccggcatcaaccattcatgtacgaatgacaaagcatcttcagctgtcgcaaacataccagcgtgtccaccagcaccgccaagcaagtgtgccttaaaatcatcaacctcaccttgcaagacgccaccacggaatggtacgtcttcagttggcacgaaacgatcaagtggcgcatcaaaacggcccttgtcagcaacgcgataccctgagttagttaagttcttgggtgccaacacattcgccgtcacatcaagtgctagcggcatatcatcaagcgcttcaagcactttacccaacaccatgaagccgacatcagaatacttcgtcactgtaccaggttcgttgattgtgtcgccaatcatcaaatcttcttcgagcatctcacgcgtcaattcaggcaccttacgcacgctacttggcaaaccagaattgtgccaaagcaattgaccaagcgtaatgtcagcgttaccaaaagttggcaaaattgattgtaccgtcgtttcgggcgttaccgttcctgacttgaataattgcaaataacgcatcgtcgtatagagcttggtcaaactcgctaagtcataaatgtggttcactgacaaaatatcgtctgcaaattcacccgtgccgacttgtccaactgaggcgatttccttttggttcttgaaattcaccacgccaactgtcgccccgaacaaacggccgtcatcgaccatcttttgggcgatattttctaggcgttcaattaattcttccattttcaatatctcctcaagacgtcattgacttcatgtagtggtagcgaagttgggcaatcgtcacatccccattactttcagggaaataaatcatacggttggcgctatcaatgcgtcgtgaccaaccaccatcaaggcctgcttgcagttcaggcttacctgtcccttcaaacggcgtgcggaagacttccttcagaagcttgtttatctttttcgttgtctttggatcttgcgtcaaaaaatattgatagtcatcgaatgcttgttcagtaaaaatcagctttttacccccgcgcataccgtcggctaacttcttagctgctttcatcgtcatcagccgtcacctcatctcttatatataccgttatcatatcatgatgaaataacagccactatgaaaaagaccgccacaacccgatgagttgtagcggtcaatcattattattagtctacataagttgcaatcgttgcttggatagcagccaactcttcgtcagcagcttgtgccgtagcaccctttgttccaacgtagaacttaatctttggctcagttcctgaaggacgaacggctacccatgaaccgtcagtcaaccagtacttcaccacgtttgcctttggcaacgtcattggcgttacggcacccgtagctgtgtccgtctcagtttgcaatgagaagtcttcaaccttggcaaccttaacaccaccaaattcagccggcgtctcagcacggaacttgttcatcaatgatgcaatcttgtcagcaccgtcgataccagcaaacgtcaatgacttcgtgttttcaacaaagtagccgtattgctcgaacaattcttgcaaaccgtcgtacaacgtcttacccaatgacttgtagtaagctgctacttcggccaacaaaaccgttgcttgaactgagtccttgtcgcgggcaaatgactttaccaagtaaccgtatgactcttcaaatccgaacaagaatgtgtgctcgttcgtgtcttcgaagtgttggatttgctccgcaatgtacttaaatccagtcaaaacgttaatcgtctcaacaccaaagctcttagcaatatctgctgcgaattctgatgacacgattgacttaaccaacgcaccgtttgctggcaaagtgccggcagccttcttagccgtcaacaagtagttcaacaaaacggcaccgatttggttacctgtcaacaattggtactcacctgatggttggcgaaccgccgttcccaaacggtcagcatctgggtcaaccgcaataacaacgtcagccccttgctccttggccaaagcaattcccattgccaaagcttctggatcttcagggtttggcaacttaaccgttgggaagtcaccatttggctcagcttgctcaggcacaatcgtcacgttttcaaaaccagcgttcttcaatgcttggccagcaatcaaagcacccgttccgtgcaatggtgagtacaccaacttcatgtccttaccaacagtgtcgatcaactcttggttaaccgtaaccgtcttcacttcagccaagtaaacgtcgtcgacatccttgccaatcttaaccaacaagccagcttcgaccaactcagcttcgtccttaactggcacttcgaacatgtcagcttcgcgaattgaggctgtgatgatgtctgattccttaggtggcatttgaccaccatcttcaccgtaaatcttgtaaccgttgtattccttagggttgtgtgatgccgtaatcatgatacctgcgtaggcgttcaagtggcgaaccgtgaatgacaactcaggcgttggacgcaacgtctcgaagacataagccttgatgccgtgcgctcccaaaaccttagcagattcgattgcaaattctggtgagaagtgacgtgaatcgtaagagattgcaacaccacgtcccttaacagcgtcgtccaatgaatccatcaaacgtgccaaaccttcagttgcttggcgaaccgtaaagatgttcatacggttgattccagcacccaaaaggccacgcataccagccgttccgaatgaaagtggttggtaaaatgcgtcttcagcagccttttcgtcagctgccaacttcttcatatcgtcttgcaagttttgtggcaaatcagtacgatctgcccaaatttggtaattttcttgccaagtcataagtctttattctccttttaataagtccccgaacttactactaatgctcattattataccatacgctattttgtgaatttgaaaattatgtgtaaaatcagtgattttcaacattttcacgttcgatgatgactaacttttcaccaccgataatgacggcatccgcaacgttcaaaaacaagccgtgttctacgacgccgatggtttgctccaaataataagctaatgcctgtggatgttcgatgacttcaagatgcaaatcgatgatgtagttgcccgcgtccgttgtcaaacgttggccatctggcaaacggcgaaatgttggcgccatatcagcggcctcaaaccgcttcaagagttggtgactaccatacggcaccacttcaaccggcaatggaaattgcccaagttgttcgtgatacttgctctgatccacaatccagatattgcgcttggaatttagcgcgacaattttttcgaagagcaatgcggccccaccacctttgataccatccaaattggcatctacttcatcagctccgtcgatggtcaaatcgattgcgggcacttcatcaactgacttaagtttgattccccaaccctttgctagtgatgacgtttggcgtgatgtggttaccccaacaatatccaatccttcgcggttaattcgctccgctaatttttcaatgaagaacttaacggttgagccagtccccagaccaactatcatgccatctgtgattagcgaagctgcatactcaccagcttggcgtttttgttctgtaattcgatccatgattcatcccccgtctattcaacttcattttacttaaccccacaaaaaaacgccagatagtaactatctggcgtggcagccattaataggctgattttcgttaaaatggcgcttcgtcttgacttaacacatcccagtaatcaaaactggtctctttagttgaaaataccccattttttatatattcaaccgcttgcacaacaatcggtgacgaatttaagtttgaaacagcgtctacgctaataagttcagcaccaaatgaatcttgaccgaaaaattggggaacttcttcagacaattcaccttcaaacgcagtgacctcataaagaacgacgatatgctgattccagtcaaaatcctcaaatatccaaggatacgtaaagctggtaactccaacctgcgaggcatcgcgcacatgcagtccagtttcctccgctacttctcgtataagcgcattctgaagaaactctccaggttctaagcttcccccaggtaaatcatagcgatatttgtatggtccgtctttcttttttacgacaaccagttgttgttgcttaatcaatattccatatacaccaaaagcccgatgaaattttgccattcgcgccccctttttgtcattctggcgttataattattctctaattaaatcgtcatttaattctaactctaaaaaggagaatacccgattaatatttcaattatgcttacctttcatgacgaccaatctctgaatcaactgaggaagcaattcgatcctctatatagcaaagttccaccgcacgtgacacttgtttttccacaacatattacgttcgaatctatcgatacgattatttctgaaatcaacaaatatggaactcacctagaaaatttcacaccgattgtttctcattttgaaggtgatttagagtatcacaacatactcgccattttaaaaagagatacctccgccattaaggtcttacatgacaagttatacgaaatacctgaatttgccgataaacaacgtctagatatcccttacacaccacatgtgactatcggtagagacctaagcgctgatgaaataagacgaattgtctttaatttatcagatacttggcatccggttgctttaagattcaaaagcattgtttttgaagaaatattacccgacgacagttcaaaaattatttaccaatacactttttaagacatatcaaaaaacgccagatagtaactatctggcgttcgatattgaataattgcaattgtttaaaatgctcggaaacgtgcgcgacgttgcttaacaagttcgtcaggtgcaagtgtttgcaactttgaaatctcatcttgcaacttggcacgaaccaaattgaagacacgtgcatgtgagcgactctctgggacgatgtagtcaataatctcgttcgctaagagatcatttggcgtcaagcccatcaattcggctgcttcagcactgcgcttggcatctttccacaaaatagctgcaaatccttccggagagagaatggaatacgttgcattttggaacatccaaacttggtcagatgttgctagggccaacgcgccccctgacccaccttcaccgtacacaatggcaatcatcggtactgggtacgtcatactttgcagaatactttgggcgattgcctcaccctgtccttggtcttcagctgacttaccaggaaaagcacctggcgtgttgataaaggtgatgataggacgaccaaacttagccgcttggtccatcaaacgggtagccttacgataaccgtatggctcaggagacccgttgcgctttgccaacttatctttgatgtcagttcccttgtcgatggcaatcaccgtcactggcttaccatcaaggttcgctaggccaccgatgacactcgcgtcatcaccagcaaaacgatcaccgtgtagttcaaagaaatcagtgaagatgccgtcaataatttcgcgtgctgagaatcgatcctcacgcgactttttcaccacctgcaccggggttaattcacgacgaaatagggctgccatttacttaacctccgctgtttggtgaaaacgcacaagttgtgcgagaattgctgccatttgtgggcgttgcacaatcgcatcgataaagccattttccatgactgtctcggcacgttggaactccttcggcaacttttcgtgaatcgtttgctcgatgacacgcttaccagcaaaaccaatcaacgcgtgtggctctgccaatgtaatgtcaccttgcatggcgaatgatgcggttaccccacccattgtagggtccgttagaaccacaatgtatggtaaaccagcatcttggtgcgccgcaactgcgcctgacacctttgccatttgcatcaatgagtgaataccctcttgcatacgcgcaccacctgatgcggtaaacaagatgactggcaacttagctgccgtcgcgtgctcaaacaagcgcgtgattttttcacccgtgattgaacccaatgaccccatgatgaagtaagaatccatgataccaatagcgacgcgttggtcttcaagggtcgctactcccgtcaagactgagtcgcccaattccgtttgttgttgcgcacgttccaacttcgccgcataccctgggaagtctgaatcggccaacttcaaatcagcatctagttcttcaaaatcattcgtcatcaaggccatgcgttcgcgtgcttgcaaacggaagccataaccacaatttgggcagacacggtggtcacccaattgctttgaatagagttgtgcgccacagtatgggcacgccaagaacaagccatctggaatgcgatcgtttaggttcgcatctcgcttaatcttgggagttgaaaccgtggtgttattaaataaatccatgcctctcctccttaatccgccttaggcagactggcttgccatcgtggcaagaactccttctccaagtaacgtgtgtcgaacatcccacgggcaaccgttggatcgtgcaacaacgccttttggaattcagcgttcgtgctgaccccgtgaacaaccaattcgtccaagatgcgatccatctttgtaactgcatcggcacggttattggcgtgaaccaacaacttaccaatcattgagtcgtagaatggttgaatcttatcaccagcataaatggcagaatcgatacgaataccaggtccacctgttggcaaaaaggcaaaatcaattgtgccggcacttggtgcaaagttttttgctggttgttccgcattcaaacgaacttccaaagcatgtcccttcaaggcgatgtctgcttgtgacacagacaacggctcaccagctgccacttcaatttgcatacgaatcaagtcaacaccggttaccatttcagtaactgggtgctcaacctgaatacgtgtgttcatttccataaagtagaaattgccatcgtggtcttgcaagaattccaacgtcccagtgttctcgtactgcaaagcgttaaccgccttcgttgcgatttcaccaaggttgtcacgcatttcttgcgtgacgccaagcgctggactttcttccattaccttttgattattacgttgcaatgagcagttacgctcagggaagtacaatacattgccgaaacgatcacgcatcacttgcatctcaatgtgacgcacgttctccataaccttttcaacgtacatgtgttcatccccgaacgcagccttcgcttcacgttgggcatcatcgaacttgtctgccaactcatcagctgagtaaacaaaacgcattcccttaccaccgccaccagccgcagcctttagcaatagtggatagcccacgcgatcagccactgccttggcttctgcagcatcacgaatgaaaccttcagaaccaggaataactggtacgccagcagctcgcattgattcacgggcgttggccttgttacccatcagctcaatcaccttagggctcggaccaatccacttcaaaccaaccgcttccgccatttcaacgaacaactcattttcagataagaaaccataacctggatgaattgcttcagcacccgtcaacaacgcggcgctcaagatattcttcatgtttaggtaactatcttttgactttggtcctccaactgaaattgcttcatcggccaacttcacatggaggctatccgcatcagctgaagagtaaattgcgacagatttaatgcccatttccttcagtgtacggatgacacgaacggcgatttcaccgcggttcgcgactaacactttcttgaacattttagtctccaataataaacgtcaaatcagctgttgtagccttcttaccgttaacgtaagcaatacccttaccctcaccgattggtccgcgcaaacgatcaagcgtcacttcaagacgcatttgatcaccaggctttaccatcttacggaaacgggccttcttgataccaccaaagtaagctgtcttacccttgaactcaggcattgacaacaacgccactgcaccagcttgggcaagggcctcaaccgtcaaagcgcctgggaacgttgggttaccagggaagtggccttggaagacctcttcgttgattgtgatgttcttaatcgcaaccgtcttctcaccgggtaccaattcctcaaccgtatccaacatcaacattgggtaacggtgtggcaagatctcttgaatttcttgtgtgtttaatactgacatgtcgagacctccttaggcatccaattcgacacggaatagtgcgtgaccgtagtcaacaacatcttcttcctcaaccaaaatttcagtaatgataccagcgacttcactcttcaccggcgtcatcaacttcattgcttcaacaatcgcaacttgctcaccaactgcaacgtggtcacccacttgcttaaatggtgctgcatctggatttggcttcaagtaaaccgtaccaaccaacggtgcgatgattgttacgccttgcttttcttccttatccaatggatgatgctcagcagctgctacaggcgcctctgctgtcgcgacactcgcaacagctggctgtgcaggcgtcgtgacaacaggttgcgcgatttcgttcttgctcaagtgcaagctgaaatcatctgattgcaatgaaaactcacgcaatgaactgttttccaaatcttgcattaaagctcgaatgtcatctaattgcaaacccattaattctcactccacttcttgaaaatgatagcggcgttgtggccaccaaatccgtagttagctgacaaaacgtagttaggggcaacaaacttgttgtcgtcattaaccaacgttacaccagcagtttcaggatcttgttccgtcacaccaacgttaactggcaattgttcacgaaccaaagcaccgattgcagcgattgcttcaatggcaccagcggctcccaacaagtgccctgtcatacccttagttgatgaaacaagcacaccgttctttccgaataccaactccattgcctttgattcggcagcatcgttagcaccagtagctgttccgtgcgcgttgacatagtcaatgtcgctagcttcaataccagcgtcttgcaatgccaacttcactgaaccagcaggtcctgatccgtcaggtgttggactcgtcaagtggtaggcatctgagttagccccataaccaaccacttcggcgataatctcggcaccgcgagcttgcgcatgttccaaagattccaaaaccaaaattcctgaaccttcacccatgacgaaaccgtgacggttaacatcaaatggctttgaagcttcaagtgggtttggctcagttgacaaagcagtcaacgcagcaaatcctgagattcccatttcgttaaccgttgcttctgaaccacccgtaaccatcacatcgtacttacctgattggatacgccagaaagcttcaccaatcgcgttcgtcgcactagcgcacgccgttgacaatgtgtagttaattcccttggcaccgtaacgcattgacacgttacctgacaccatgtttgggatagcgtttggcacgaacattgggctcacacgttgtggtcccttgtcgtgcatcttgataacttgttcttcgatcgtcgtcaaaccaccgattccgttacccatgataacgccgaaacgatccgggttatcaacaccatctgccaaaccagcgttttccaaagcttcaccagctgcgtgaacggcatattgtgagaacaaatccatcttgcgagcttcgcgctttccaacgcgttctgcaggatcgaagcccttcacttcaccggcaactgtgacaccagtctctgtggcgtcaaactttgtaattggggcaataccaacttgactgttaaagattccatccaaaaagtcatttgctgtattaccaacgggtgtaactgcacccaaacctgttacgacaactcgtgtcatgttgttctcctctactttcctaaagcgttagatacgacttatttaaataagttacgaaagaataagtgcatcaagtcgtatctggtttccttagatgtacaatccaccatcgaccgtaattgtttggccagtgatgtaatcgttttgagccaagaacaaggcagtttgtgcgatttcagccgcgtttccaaaacgcttcaaaggcacagcctctaggacttgttccttaaccttgtcagacaaagcatccgtcatgtcagaaacgatcatgccgggcgcgattgcgttaacacgaatgctacgcattgcgccttcctttgccaacgtcttcgtcaagccgacgataccagcctttgacgcagcgtagttagcttgtccaacgttacccatcaatcccaccactgatgcgatgttaatgatgtttcctgaacgggcgcgcaacatcttcttgaagagtggttgcgtcacgttaaacgtaccgttcaagtttgtgttcaccacattggcaaattcgctaggcttcattcccatcgccaacttgtcgtcaacgataccagcgttgttaaccaagatgtcgatgccgtctacttcttcaagcaaaactgtcaacgcatcgttaacgctgttttcatcagcgatatcagccgtaattgccaatgtgtcttcactgaattcagccattacttcaggcttcacggctgaacgtccgtgcaaaataacacgtgcgccagcttcatcgaaagccttggcaattgccaacccaataccacgtgttgatcccgtgatcaacacattctttcctgcaagatccattattgtactgtctcctgttctgcaatcaacatgtcgcgaacttcattaaatgaagcaaggtccttcacgcagtagcgcttaacgtccttaccaacaatcttcttggcaaacttcatcaaggtgtcgcttggaccaaattcaatcaacgtatcaacaccatcatcaaccatcgcttgcaacgcttgggcaaagtaggttggtgacgtgatttgttgcaacaaggttgccttcacgtcgtcaaatttttgacccgtcgtgtttgaataaacagcgaattcaggcgtgttaaacgtttcgtcagttaagcgaactgccaattgatcagcagccgtttgcaacaatggtgtgtggaaagcccctgaaactggcaattcaaccatacgtgagacaccagcttcagttagcgctgccatggcatcattaacatctgcttcaataccaccaatgaccagttggttaaatgtgttgaagttcgctggataaacgcgcttgccagctgcttgtagcttttcaagcgttgcaactaccatatcttgttcatccgtcataacggcaaccatcttacctgggttggcatcaccggccgcttgcatgtaagcaccacgatccttgataatgcacattgcttgttcaaacgtcattgcacctgcagcagtcaatgcactgtattcgcccaaacttaggcccaatgcagcggctggctttggcataacgtctgacaaagcattgtaaatacccatactcattgccaaaatagcaggttgtgtgtacttcgtttgcttgatgttgtcttcactatttacaatagtggccatgacatcatagccaagcaactcactcgcacggtcaattgtttcttgatattcaggtaagtttgcgtacaagtcagctcccatgccaacttgttgggcaccttgaccactcatcaatagtcctagtttcatgttctctcccctgttgtttggttagttcaacaagtcttcggcttgtgaccaaacatcttctagaatttgtgccactggcttaatctcagtaatcattcctgaaatttgaccagccatgaaggcaccgttttccttatcaccatcaagcacagctcggcgaagtgaaccattttcaagttcttcaatcgcatctgcatctggcttaggctttgtgatttcaatacgttcttgtttaacaaagttctttgacatcttcgtcttcaaaacacgagcgcggttacccatcaattcaccggtaaccaacgtatcaatgtcctttgccttgacaacggcattcttgaagttgtcgtgaacttcagattcttccgaagccaagaaacgcgttcccatttgtacacctgaggcacctagcatgaaggccgcagcaacgccgcgaccatctgctataccaccagctgcgataactggaatcttcaatgcgtcaactacttgcggtaccaacgtcatcgtcgtcaacataccaatgtgaccacctgactccataccttcagcaacaaccgcatcgacacccttcttttccatcatcttagcaagtccaactgatggaacaactggaattaccaaaatgccgtggctgtgcaattcttcgataaatggtgaaggatcaccagcaccggttgcgacaaccttaacaccttcttcgatgatgacgtcgaagacttcgcgaatgtgacgtgacaacaacatcacgttgacaccgaacggcttatcagtaacttcacgggcacggcgaatttcttcacgcaccttatcagccttccaataacccgttccgatgatacccaaaccacctgcctcagagacagcacctgcaagatgaccagtccctgcccaggccataccaccttggatgatagggtacttcatgcctaacttttcaaataatggattatttagcttgacgctcattttgcggttccctttctctttgggtctatgtgattaggcgtttacttgctcagaaaccttgtttaccaagtcttgaatagtttgaatttcttcagcaacagccaacttgatgtcgaagtcgtcttcgatacggttcaacacttcaaacaaatccaatgaatctgcgtcgatgtcttcagtcaagttcgtttcaggcttaacttcgccctcttccaaatcaaattggtctaccaagatttcagttaccttgttcaaaatttctgcttcagtcatgttaatatcctctgttttctttaaaatttaaaagtagtttgaaaattaaaatgtatacgccatatacaattttagaaaaataaattacaccttgataatcaaggcaccaaccgtcaatccaccaccaaatccggcaattgcgattgtttgtcctgcgtgtaccgtgcctgcttcacgaagttcgtcaagcaagataccgatacttgcagcacttgtgtttccatatgaagccatgttcattgggaacttttcaattggttggccaaaacgcttcgcaatactgctgataatgcgtccgtttgcttggtgcaataggtaaacatcaatatcatcaggtgttaaatcagctttagccaacgcttcatttaagacatttggtacttcgcgggttgcaaagctgtaaacctcacgtccgtccattttgaaatatggatcagccatcttcaacgtaccggcaaaatgatttgcgttttgctgttgaccagccgttaggaactgtgaacgttcaccaaacgttttcaatgattcagctagcaaaccagttgctgctgttgtgcgttctagtaagacacccgctgcgccatctccgaagagtacggccgttgaacggtcttcccagtccacaagtttgctcaacacttccgccccgataactaagcctcgttcatagcgcgttgagagcaatgaacttgccatactcaacgtataaacgaaacctgaacaagcagcgcttaggtcccaagcgaaagcattgtgcgcaccgattttcccctgcacaatttgtgcaacactcggtgacaatgtatccggtgacatcgtgccaactaagatgaaatctagttgatccgctgtcaaaccagcttgatggaggagtttttctgctaccgtcacagccaaatcactggtatcttcagtgtcgacgatgtgacgttgccgaattccagtacgtgaactaatccattcatcagacgtgtccatgaatgatgctaaatcatcatttgtcacgactcgtgacgggattgctcgcgctgactggacgatggtaaatttttccatgtcgccctctcttagaactggatcaactcgtgaagatattcttgcaaattaatcactgctttacgtacggcagccgcttcatcgtcggatagagagtcaaacaatgagtgggccataccgcggtggaaagcctcgtgtgcacggaaaaccgtacgtcccgagtgcgttagtacaagatggacaacacgtcgatcttcgtcatcacgacgacgctcaacatatcccttcttcactagcttatcgattacgctcgtcatcgcactaggcgtcaagtgcaccatttcggcgacttgtgacgctgtacgtgtctcatacatcgagatggctgcaatcgtatgcatatccttaatcgtgatgtcattaaactttgattcacgcaatgaggcttcctcaatccagacaacgttgttgaaaacgttaactagggccccattaatctgttcgaacgatgcttcttcactagctgccatacttacttctccgtctcactcttggcgtcagccgcctttttctcgtcaggtgaaacaacaaacatcaattcggcgctagttgctaacttgccatcaaccatagctttgacgtttactgttcccatgttctctctcagattaccgaattctacgtgtaacttcaagacgtcgcctggttttaccatgcgcttgaacttggcattatcaatacccgtcatataagccgtcttaccaacaaattgtggtgatgacaaaatcaagattgatgccgcttgtgcaagtgattcaataatcaacacaccaggcataactgggttccctgggaagtgaccttggaagaattgttcattgattgttacgttcttcgttgcgatcaatgattctcctggtgtcatctcgtccacgtaatccatataaagaattggataacggttgggaatcaaatccatgatttcagtcgtcgttaaaactgccatagtctcactccttccaaaaagtatttcgaacatcaaactattcgatattcaaatcatattttgttttacgcaaaatgtcaacacaatttagaaataaatatacgtataccccgttgactatatgagctacaaatagctgaaatgccttaaaataggcatttgaactagttatatcttattcacgaaattcataaaaacagtaaatttatgcaataacttactttttgtacacaaaaacagggatgatgttcgctgccatcatccctgtttgatctattctactattctgaatccttatgcatcttttccttcaagtcttcaaccgcatcggcagccttttccttgatatcacccattgcatcacgggccttaccagcaaggttttgtgtcttaccttcagcttcgacgcgctcgtttccagtcgctgatccaacaacttcctttgtctttccagctgcttcgtcgtactttcccttaacgtgatctgacattgccatataaatcatccccctttgtttgattgctttaatcataacaatgaagcgtccgcatgacatctgccaaacgggtaagcttagtcagctagacccacgcgcttgaagatatcgtcaacgtgcttcaagtgccagttgtagtcaaaggcatcgtcaatctcagccttcgttagtttctcagtgattgttgcatcagcatccaccaaatcacggaattggagttgctcatcccatgaacgggccgtcaatggttgcaccgtatcgtaagccgcttcacgagacattccagcatccaccaacttcaacagcaatcgttgtgagtaaatcaaaccgtacgtgcgcttcatattagccaacatcgtctctgggaagacttgcaagttctccaaaatcgctgtcaaacggtgcaacatgtaatccaatactgtcgttgcatcaggcaaaataatacgctcagcacttgagtgtgagatatcacgctcatgccacaacgcaacatcttccatagaagtaactgcataaccacgcaaaacgcgtgacaacccgacgatgttctctgaaccaattgggttacgcttgtgtggcattgctgatgatcccttttgaccgcccttaaagccctcttcaacctcatgaatttctgaacgttgcaaaccacgaatctcagtggcaacctcttccaacgtcgtgccgataacagcaatcgttgtcacgtagtcagcgtgcaagtcacgtggcaaaacttgtgagccaattgcttgtggcgttaggccaagttcagccatggctgcctcttcaacagttggtggcacattggcgaatgtaccaactgcacctgacaacttccccgtttcaacagccgctgcgacgcgttcaaaacgctccaaatcgcggacagctgcttggtaaaagcgagccatcttcaagccaaacgtcgttggttccgcgtgaacaccgtgggtacggcccatcattaccgtgtgcttgtacttacgcgccaatgtcgccaaaacgtccttgtaggccgccaagtctgccttaatgacgttgtttgcttggcgtagacgcaatgcttgggcggtgtccacgacgtcagttgacgtcaaaccatagtgaatccacttacgctcatcccccaatgactctgacacattgcgcgtaaaggcaaccatatcgtgacgcgttgtttcttcaatctccgcaatgcgatcaacatcgaattttgcatttgcacggattgctgccaaatcttcagccggtacgtgcccctcagctacccagccagccgttacagcaatttctacatctaaccaagattgatattggttctccaatgaccaaatgtggcgcatttcaggtcgtgcatagcgatcaatcatgtttatcccctcgatttaacagtcgtaaaatacgaacaaaacttttataacacatattattgtacattatttccgaataattttacaccatttttccagaaataactaaaaaacacgtaatccaggattacgtgtttcgtgtaatatcttattcagctgaagagctttcttctgatgatgaactagcctcagatgaacttgatgcctctgatgagctagcttctgaagatgaagactttgatgatgccttgtcagacttgtttatctttgacattgcagcagcttgcgtgtacgttgacaaaacgttcttcaagtctgaatccttgatgttaacgtcagccttagccaattcgtttccgattacagcttggaccttcgttgaatctgacatttcttgttcaaccaagatatcagtcatctttgacttcatgtccttgaatggcttcttttcatcacgtgaatccatcttgatgacaaagtaacctgagtacgttgatgacttaactggtgtcttcgtgtactcacccttcttcaaagcaaacgcagctgtcttgaagtcatcttcaagcgttgtgtttgttgagtcgaaggcttccatcttaccgcccttgtccttagtagaagagtcagttgacttctccttggccaagtcagcaaacttcttaccatcatccaattgcttgatgatgtccttggcttcatcttctgaagaaaccaagataactgacacgttcacatcaggtgtgtagctgtcgtaagctgacttcaattccttgttagagaactttgagtttgccttaaccgcttccttttccaaagcttgcaagcgcaatgaatcacggaatgtatcttccgtcataccattgttagccaaagctgaggcgaattgtgcaccgtattgcttcttaactgagttgaattgtgagttaactgacttctcagaaaccttatcaccgtagtttttttccaaaaccttctcgatgatcatgttggccaattgttgttgaccagcactcgtgttcttcaacttcttgtaataatcagcttgtgagatgttaccgtcattagttgtggcgattgacttaggaccaacgccccaggctgccaatcccaaagctgccgcaacgacaaccaaaatagctactactttcttccacatggaaaaatgccctctttcaatatttatatatgtgttttagtttaccataccaagctttaagttgcttaaagcacttggtaggtcgcacccatcgcaaagcgcccgttatccaacgtttgctgaatattcatatgttcagcaaagtctgcatcacgataacgaagacgtgctgtcttaatacgccatgataagtccttcagattatcaaccatttcttcgtcggccgtcgtttgtttattcaacatataacgaacgattagtcgaagccatgatacaccggtcaccttatcaaggaaggcaatatgcgtaaatggcattggtcgaatatcatccgacgtcacctcatggtccaatggcaaacgatccgtcaccaattgatataagccggccgtatcaagcgtcatctcagggcgtggcaatgattgccacaatgagtccgtcatcgccgattgatcgaagaagataccaccgttatcttgatggccgaccccaatcacgtgcaattcgagcccatcatagaagtaattcacaatggtttgttgaccatcacttagcatactacttgggaggtacttttctttggcgattacttgaacatttacacccatcttacgcaaactcgtaatcaacttaatgcgattacccggcacaaatacgcgcgttggttgctcaatttcaatgacgttcatcacatcagaaatttccaatggctcataatactgcttgtgcgctagttgcggaatgaacgttaagtcagttggattgttattcatcaagaccgtcttaatcccttggcgagacaattcatcagccaccatcgccatggtgtatgacgctgctgccccatccccaagacgaaaagctccggttccaatcaccaacgctgaatcatccccaagccgttcactctcattctccgtttcaaacgttgaatagaattgtgagactgactcttcgaattctccagctgacggttcaaacgccttgtaggttggcaaaataccattatcccaacgataacgacgcactgcctcatacttttcgtcccacaacttggctaccaagccgtcagacaacccataatacttggcttgttgcaatgtgtcggtatcccatggatgatccttcacggcactttcaagattattaatgcgctctaacttatagaagtaaaacgcattaatctttgttagctcagctaattcatcaacagtataaccgcgacgaatagcttccagcaaaaccaaaatacggttatcgcgtgggtgaatcaattgctcaataatttcattatcggtcaacgcattcataacagtcggtgagaagttacggttgttaaagtgcgcggcacgaatggccttttccaacgcttcttcaacacttcggcccacaccaatcgtcgccccaaccgatttttgcacagtatccaaacggttctccgtttgaataccagctgactccagttcaccaaaggcaaacactgggaaacgaatgacaatgtggtccatggttggttccaacaaagccgtgtgttccgcataaattgacggtacgcgcaccttatccagcgtctcgcccatcatcaagccagcaataacgggtaccaatggataacccgtggctgccaccagcatagctgaggtacggtcaaagtaaggcgtcaaacgcgtgataacgtactcttcggtcgttgggttaacagcgaaacgcacctccaacaagccgacgacattaaagccacgggcgacggtaaaggctgcgttacgtagttgttggaatactggatccggcaacgtttgcactggcgtaatcgcaatcgaatcagctgagtgaatccccaccggatccatatcctcgacaccaccaattaacagcgtcgtatcgcgcttatcacgcacaacgaccatggcaatttcctggtaaccacgaatactcttatccacgttaacttggtgggtcaatgaacggttcaacgccgtctcggctgccccttccagttcttccacatcctcaacttgaagacgaatcgtttgcccaactggtgccactgaacggaccaccactggtaaatcaaattcacgtgctgcatcgaatacttcactcacattgcttgccaaacgcgtttgaatggctggcaatttcaacttcgtaagacgttcttgcaggtacttggtgttttgcgtcgcctgcataactggcaacgtcattcccaaaacctttggcgcactatcaccaagcaattcaacgatttcagctgacaaacggaccgccgttgagccaccgacactggcgaccatcgcggtaataccttgttcgacaatcaccttaactagattgggcgccgttagctcagtttcaattaccgtcacgtcatcgcgttccgttgtgaagccaaatgggttatcatcgacaatcacaatttcatgacctcgtcgacgaagccccttaaccacttgatagcttgctgcatcactttcagtttcacgaccaaaatcattagcagagccaccgataattaagattcgttcactcatgatagccaccctcctcgacgtgcagtcaccatttccataaattcatcaaaagcttgcgttgcttcaattggtcctggtgctgtatctgggaaaaattgcacactaaatgccggatagtcacggtgacgcaatccttgaataatcccatcggtcataccaatatgcgtgacaaacatatccgtttcacgcacagagtctggatcaacactgaagccttgcccctgcgtcgcaaacataatgcgattcgtaatctgctcacgaattgggtgattcatgccatggtgttcaactggcatttgttgtagttcggcaccattggcgagcgcaaacaattcgtgccccagaccgatgccaaacattggcacacgttgctcaaattggcgaatgatatcaaacgtttcatccggaatttgacgtgggtcacccggtcctgatgacaacacgatgccatcgggatctaagttagcaacttcatctgacgtcgcattgtatggcaacaccgtgacgttcgcatcaaagtcactcagcatgcgcaaaataccattcttcaagccgaagtccagcaccaccacattggcgccgcgccccgggttggcataagccttgggtgttgaaacttgtggcacctgacgcgtcgtcaaaaccatcgcccgcaattgatcaaaggcgtggtcatctggcgcatcgacaattgaggctttttgcgtacctgttttacgcaaatgccgggccaaagcacgtgtatcgatttgcgaaataccaggtacgttgtgacgcttcaaataatcgtgcaaactcattgattgcagacgattggttgagatatcagcgacttcgcgcacaaccacacctttaaccgttggcacaattgattcatccgcacggtggttaatgccggccgcgccaatcgttggtgatgtaaacatcacaatctgattatgataaatcgggttagtaataacttcctggtaaccggtcatccccgtgtgaaaaacaatttccccaaaattcgtcgcaggtgatccaaacgcttcgccggcaaaaatcgtgccatcttgcaaaattaaataacgttttgtcatgacgtcatgcttaccatgtcgttaacatggcaagtcctcctttccgtcctgcgagttaattaacgaatttcaaccgaatcaacaccgtcaacttcttcaacattgacgttgatacgctcagcagcagccgttggaatgttcttaccgacgaaatcggcacgaattggcaactcacggtgaccacggtcaaccaaaacagccaagttaaccactgctggacggccgttatccatcaaagcgtccaaagcggcacgaattgtacgacccgtgtacaaaacatcgtcgaccaagataacacgcttgccatcgatattcgtatccaacaccgcctttgtgctacggtccgttgcatcgtcacgataagttgaaatgtctagttcagcaactgggatttctgcattttccaattgttgcaaacgttctgcaatacgttgggcaatataaacaccacgcgtcttaattcccacaatcacgaggttattaatacccttgttcttttcgataatttcgtacgtaatacgtgtcaaagcacgttgcattgccattgcatctacaatttctttagccataatcgaatcccttatctgtttatgtatacaaaaaggcgtcacctaaaaaattaggtaacgccaagtttaaaatcaacatgtctcgttacctcttgcatctctctggatagcattaagaagtaacttcattttagcacgaaaaccgcgtcgtttgggacttagtttgcgtcaatttctgcatatgggtctaattgatccaacatttctgtaaagtacgctggtaatggcgcctcaaacgtcatttcttcacccgtcgttggttgtgtcaaaccaagcgttgccgcgtgcaagtattgaccgttacctggcaacgtcttctttggtccgtacaatggatcaccagccactgggtgaccaatgtaagccatgtgcacacgaatttggtgcgtacgacccgtttcaagcgttacttgcaatagcgtgtaacccacaaaacgcttcacgaccttaaagtgggtcacggcatcacgaccaccagccacaaccgcttgcttcttacggtcagctgatgagcgacccaatggcgccttgatggttccttcgttttcaatgaattcaccgtgaacaagggcgtaatattggcgcaagttcttcttgtccttcaattgtgctgacaaagcctcgtgtgccttgtcattcttagcaaccatcaacaaacctgacgtgtccttgtcaatgcggtgcacgataccaggacgaaccaccccgttaatcgttgaaagtggcgtgtggaacatcaacgcgttaaccaatgtacctgattcgtgacccaaagctgggtgcacaaccatcccttgtggcttgttcacaaccaataggtcatcatcttcataaacgatgtccaatgggatgtcttctggcttcaggtcaatctcaactggctcagcaaccgtaaaggtaatctcgtcgccaggctttacgctgtacttggccttcttctcggcaccattcaccttcaatacgccgtcgttaatccagccagtcacttgggtacgtgtataatcttcaaacgcgtcagcaacgaccttatcaagacggccagtttggtccgtgattaccaatgtctcttctgtcataaaaattctctatccttcaatcttctcttgtagagcatgcaacatacgctgccccatcaaaaagctgtattgctcaccgtcatggctaaacataaccgtgtgcttgttaaactgtacaaattccatatccttaaagtggattttctcggtgtgcatcccaataatatgtgggaaacgcaacgcatcatcttccaatgtcacacgtcgacgcagaatggttgcagctgtaacgacgacaaacacgaagaatgaaacatatgtccaaacgttaagggttgtcacctcaagccacataatcatgccgaacaatgcaatcatcaaaatccacgtccacgatacccagcctactaaaccggcgggttggtaaaaacctttcatgtctacgctcctttcgggagttcatgctattttctagtataatgaaattagaggtttttgtcatgttaatcaagttatatgctgatgccgcaacccaaggaaatcctggtccaagcggtgccggcgttgttatctccgccgacggtaagcaaacacagcttcatcacgcactgggtgagatgagtaatcacgaagctgaatttcgagccgctatttttgcctttgagcaattactacccattgcctcacctgatgacacggtgatgttttacatcgattcaaaattagtggctgacagtattggtaaatcgtatgccaaacattatcctgaattaatcgccaccctaatggcgctgattgatcggtacaagattgtcttaacaacgtggattcccgatcgtgaaaatcaaggcgcccacaagctggctttgcaagccattcattaataacaaacgcgcgcacccactcggatgcgcgcgtgttactttatgatgctttcttaataccgatgcctgtccaggctgacaacaacgagaacactggtgacaacaaggcaaagaagacaaatggtgcgaagttgtgaaccggcacacccagcgtttgtgcagcaaaactacccgccacaccccaaggtaccaagtagtttacaaccgttcctgagtcttccaatgaacgtcccaaagccaaccgtgacaaaccaacacgatcaaaggctgacttccaaagttgccctggcaaaatcgttgctaagtattgctcaccaatcataaagttagcagcgatgccagtaaagacagttccggtaatgacgccagccccactcttaatgcgatcagcaatcggtgccataacggcctgcaaaatgcgttgttctgttaacaaaccaccaagagccaaggccaacataataatgatgacagttggcatcatcgctaacatgccaccacgattcaaaagcgcttgtagcatctcattcttagccgtcgtcttgaaaccgttcaacaagatatcacccagtactgctggcgtgtgattaagcaagaagaatgcgcccgtcacggccacgttgattagcaatgttggaatagctggcacctttgcccaggccatccccaccaacaaaaccagcggtacaatcgtccaccaggttggtgacaacaagttggctaagctcgccaactttgcggttgaagcaccggcatgaccgccaccaatcacaaagaaaataatgaatgacacaaccaacgctggaactgtcgtccacatcaaattcttgatatgcgcaaacaaatcagtttctgaaattgatgatgccaaattcgttgagtctgacaatggtgaactcttatcaccaaaaattgcacctgacaacacagcaccggcaaccaacgctggctcaaatcccatcgccgtaccaacacccatcaaggccaccccgaccgttgcaagtgtcgtgaacgccgatccaatcattgaacccacaatagctgttaccaagactgcacttggcaagaaccaagcggcattcgcaattttaaagccaatccacagcatcgttggaatgacgtttgtgcccatccacaatgcaatcagcatcccaatcaataggaacaaaaacaatggtgccaaagcagtttgcaaaccgctcaacatgtcacgttgaatgtcttcccacgtcgcgcggtgcaactttgcaaagaccatcgtgaccaacaagcttaacgtcaatgggacgtatggtgataacccaagaccaataatgctaccagcaaaaataataatcaaaataacaataagtgctaacgcttgtccaaagcgtggtgttgttcgcttttccatatgtatactcctcgttcgttacaatctaatcagttcaactttcagttatagctgcgataacgaacaagtccgccaacgccacgtgttacatcaaataccccatggtgcaatcctccaaacaaaataaaaagtcccagtaacctgcaaaaacagattactgggacgaattagcaaaaatccgcggtaccacccaaattagtcgcatacaatcgcatgccactctctttcagactattccgttgtaaatagtttagtcataacacctgcgccactcacagcaaccgtggcttctcttacgtacaatgttatgtcctactgatgtgtctcagtttacggaatagatgagtgcttgtcaacactaaaatgagatttttttaatattcatcggcaataagattatattgcattgcaatccctagattaccattcgctgtacgcaaggcatcaataaaggctttatcgtccatgccttgcttcatgcttagcaaatattgtaactcgaacagtgaccccaattcagtcgttttaatacgcttcagaataaacttttcggtgtattcggtcaaaattgcttccacctcttgcttatcatacaaatcttcaggcaccgttagcttgagcaattgatcagtcgttgcgtgaccaccaaagtccaccatattcattagtagcatggccaatagcaataacgttgcggcgatcacagcatacgcaatgtatcccaaccctgacgccaaaccaatggccatcgtcagtaggacatacgtaatctcagccggatcaccaggcgctgaacggaaacggataattgagaacgcaccggccaatgaaaaggcacgggcaacgttattccccaccagcataataatgaccgcaatcacgactggcaacaaaaccaatgtgaatgaaaatttttgtggtgacactcgtgaattataagttttcaagtaaaccaaggctgtcacgagtcctaatatcatggccgtcaccatcgcaataataaacgttggtaatgtgatggcagttccagaactgctcgttgtaaaaattgaattaagcatgtgcaatttccttttgtaaaatatctgtgtaagtatcgttgctctcttggaagctgcgttttagcccacgttcaaatttcgaaaaactcgtgggacgcaactgataatcagctactattcggcgcagaaacgtcggcattcctaactcggttttaatttccatcagcaccattcctgctggtaacaaattctcaccaatcgtttggtttgaaatatttaaatccaatgttgatgtcctgatgtccgtgtcaaacgatattcgtaagtcgctatcgcctgacgtcgcatggagcgcaactcgttcgtaggccaccttaatcactggttgtaattgtttgcgggctaacgctagcacttcacgaccgatttgattgtccggtaattcacctgcaatcaaaaatcgattcgccgtttcataatcgaccgtgatgcgacgcttataggttttcttcaaaaacttctttttaatctccaggaaaactggcttagtcgtagttgctggcccataagatcgcacacgtagtcgttgtttaaattcattgggttctaatcgcaacgcttgctgcgagacggcatctgtcactgatgcataatagagcgattgaatcggatacgattctcccgtttggttataccgatctagtcgcatatcctcagttgcaagtaacgcctgcaaaatagcctcgtactccgcttgagtaatgatatatttcacttcatatcgattgaaaacttgcatattatcaccaatcagccttaacgcatgccaccggctggcccgccaccagccatgccttcagtcaaaccagtaccggccgtcacttcagtcgtcgtaccattcacagtaaccttataagtagaccctgacttgatgtcatttgacgcaacggcaaccgtgtcaccatcagcgttaactgtgtagcttgcaatcgtcttgtttgcatcatcgaccaccgttaccttatcgccctgcttaacgccacttggcaacttcacataagcattatcaaaagttgcaccagtgcccgttccaccgtagagcatcgtaccgccggtaaaggtcaacgtgccatccaaatcgaccgcctcgttgtctggggatgagttaatcatcgcttctaccgtaccacctgacatcgtgatgtccccgttcgaatcaagaccgtcaccgccagctaggaagaccagcttaccagattggtgtcttgtaactacctgatgcgttcaccgcatcatccgtactactaatcgtggtttcaccaccatcgatatcgatttcattggcttgcataccttcatatgaactcgtaaccgcaatcttaccgcctgaaatcactaacttacgttcggctgaaataccgtgattaccatcttctgtacccgtggcgactgtaacgtctccaccggtaatttcaaccaagcccttattttcatcattgtcttgatttgattcaatcgcatcatccccagccgacacattaaccgtaccgtcagtaatgtgcaccgaatcatgaccaactaaaccgtctttaattgccttggcaaacactgttcctgacttaattttcaaatcgtccttggtatacaccgcatcctttgaatcgccattaatcgcgaccacaccgtcacccttaaaggttaagtcgtgcgttgcataaatggctgctttctcctcgtcggtatcagcaatcgtgccgccgtcaatcaagttaattgaattgttcgctgatgaaataatggtcttatccgcgttcttctcatagatagctgggccagtcgttgatgttagattcacaccgttcataatgatggtgacttcatccttatcaccagcatcaacgacaatttgtgcatcgctcgctgaacctgtcatgtaatacgtaccacccttagaaatcgtgatggtcttatcagacaccttaacgcctgaaccagttaccttcatcttagataagtccaccgtaccatcggccgtcaccttgcttgatgcatcaccggtttgcgctgtggttggataaggcgttacggcaatctttttcgcgctacttgttgatgagcttttagcactagccgtttttgtgacttcgttattagcatcgtcattatctgattgcaaggctgcataacttgcaccacctagcgccagtacacccaatacaccaatcgtcgcaactgcttttttatttttcatcatagtctttcacctcgataatttgtactattactatgcccggcaaaccttaaacgatcactcaaaggagctgatgtcaaacttaaattttgtgaataaaaaaagaccagccgttgggctgatccatccaaattaagccgttaagccgatttaattgtttgaaatacgccaccaattaatagcaaggcagaaataacatagtacccaacaataaaggtcgagcccgtccctgcaatttctaagataccagcgacgatcaaggcaacgatgaccgaccaagtggccaaatccccccacgcccagaacgttttgtgttttggggtttgggcaatttctggcttaatggttaccaccaatacttgccaaatcaacaccgctgccggtactaaccatgcccaattcatttttggcgactgtaccccgtgaccaaaatggttgtaaatcaggtggaaaataaagataaatcctgtcacaccgaaccacttaatcgccgtttgatattttgccatattttcctccttactcactgtagccaaagtacaacatatccgacaccgtacgttcactagattgaccagacccgcctactggattgttaatcactttgccgttaagcaccatagttgatgatccgccaccatccaaattgtaggcgtaggttgccccgtgctttttcatcacattcgccaattggtacaaagacaggcctgttgattctgacgttcggccatcagaaaccacaactacgtaatgatttttaccaacctgtccaattgcggtacgtggattagaagcctgtgactgaccaacttcagcgtcctcagagacagttactttaccgttttcaaccagggttggcccaaaactcagtacctgatgagcaccatttttaagcagttcactcgctgtttcatcactctgattaactgacttcatattgccatcgctatcaataactaatgcatccgtatcggtcgccacagtatcacgatacaatgtgccattacgcacaacataaccagtatcgcggaagccataataatcaccattgatcgcaaaaatcgcattatgctcgcttgccatcgatgacgttttttcagtgtagtttcggccatatgtattattagccaaggccgtttgcaacaggctcggatcatcaatggttatatcagccacgtatactgtcgtgtcatcaacacgctcagttgtgacgttaatactcatgtgactatcctcataggacgtggccgtctttttgaccgtacttgaatctttcttcgccgttttcttgacggtttgtgtgcttgtcgcaattgctgtaccactgtgctgtagcataaacgtatcgaccagtgtaaaactcgtataaaccgtcaaaattgcggatgtcactaacgttaacttacgcttcatgcgttttctccattcgtgatttgaaaaccaatttcttttgtactaaatagctaccaacaaatattagagtgtctaccattattttcaccggcactggatgcggaataaacgtatccactaactgtaataggacagctgataagaccatttgaaaggtgaataatgcgacatagcggcgacgatcaccagtcgtattttgtgacttaaacacccatcgttgattaaggatgaagttaaaaataccagagatgaatcgagccagcactgatgcccctaataaactcattgtggaagcccctttaaacaaggtcagcagcaaaactgcaaacaacgcaatgtcaaccatcgccgaactcaatgatgagacggcaaatttcaaaaagcgtttgtagaccaatagggaatcgcgaattgggtgaaaatgggtgccttcattgttgtcctcgtaaatagtttgaattggcaccagtgctagaccgatgccccgttcttgtaactccagcaacatgttcatttcatattcaaatcggtcaccactaatctcgctcatcgctgacaatgtgttgcggggcaatccacgtaagccagtttgggtatctggtatgactagtcccgttgcaaattgcgtcatcttgctagttaatttgttaccccagtaggatttaggcggtacggcacccttttcaaaattgcggacacccaggatcaaatcttcggtaccagcctccagcttttctgcgattcgaatgatgtcagcgatagcgtactggccgtcagaatcggccatcacaatgccagctgtgttaggaaatgctgtttggacatacttaatccctgtttttagcgccacacctttaccacgattctggtcatgtactagtaccgtggcacctagctcttcgatttgtgcaaagattgtttggtaatggatgcctgatccatcatccaccaccacaactggacgattagtcgctgcctgcagattaatcatcacggtaataaaattttctgttggttcataggccggaatcaaaatcacggttgccgaattattagtttttgtcataaaaattgcctctctttcgattgttggcaatcataatgaaccgacccaaaaccaaacttcagcgaagcacaaactaaacataaagcagactgggaatgtcggaggcttgtgacccccgacgtgaccaagtcgcccttatcaggtgcgtctttggtcttacacctgactgaagtcaggggttttagaccaacaactgctgtgataaaggccgtgaatttcttgaatctgcttcaagaaattcacggccttaaaatatcgccttcagttgtttacttaacgttgtaggcttgcaaataacgacgtgtttgcaagtccaaccagtattgtggattcaaatcttcaccggtagcatcacgcaatacttgtgatggcgtctttgatgccccgtattgccatacgtgttccttacgccagtcgaacaatggttgaatatcaccagcttctagcaagccatcgatatccaacgtcttcgccatctcgtgacggaattgagccgcgtacaaatgacccaatgcatatgatgggaagtacccaaagtcgcccccagcccagtgaatatcttgcaggattcctgtcaaatctgacggtggacgaataccaagatactcttcatacttagcattccacaactcaggcaacgtttcgacatcgatgtcatcattgaagattgccttctcaatctcataacgaataatgatgtgcaatgggtacgtcaacggatcagcttctgtacgaatcaagctggcttgcgtcttcatccagcccttgtagaacgtttcaaaatcaacgtcgtctagaacaccatggaaagcagcttgcatacttgggtaatcatgacgcaaaaaggcttctgaacgtccaatgaccacttcattgaatagtgactgtgactcgtgaatactcatcgcaatcgctttgttaaatggtgtgtaatcccactttggcgccacgttttgcgcaaacaacccgtgccccgcttcgtgcagaatgcccaacacggccatttggaaatcgtcggttgcccaacgcgtcgtaatacgagcatcattgcggttcaagtcttgcataaatgggtgaatcgtatcgtccaaacgtcccttgtttggatcgtagcccaagcgaactgcggcatcccaaacgtacccacgttgatcagcaatcgcgatatcacggtggaggaaactgtcatccggttcagttccttctgttgccaaacgattacgcaaagccacaacacccgccttcacttcattaaagactgcgtccaacttttcaaccgttaagccaggctcaaattggttcaacaacacatcatatggtgtggcctcatccttgcgccagtacgtaataaacttgcgcttcaacgcaatcaattgttggaggtatggtgcgtaaatgctgtaatcatcttgctcacaagcctctgaccacgcgtcttgcgctgatgaactcaacttgttaaacgcaatgtactcgtcagccggcacaaccgcatcacgctcataatcttccttgaacttcgcaaacaaagcttgttcatcgtcagaaagttctgaagcatgttcgtcaaagtaagccaccaacgctttggcttggtcaccagttgaaacacccaaatacttttccgttagataactttgtagttccgcacggaattcacctgaatccttgggcatccccgttagttgatcccagctggccaaagccattgtttcttccaacaaggcttgttctttcaatagcgcgcgtaaatccgcacccgtgtatgagtccgtcatctcataacctccgtttttagtcgtttctttattctaattgaattttaatataaaaacaaaccagaaaaaaactcaccaaccgaagtcagtgagttcaatcgtttttaaaatttcatgccgtacttcttgtggctgtaccaaccgtaaccaatcgtccaggcgataccaccaaaggccgcaatcatgtctgtcttgtccaagaacaaggttccgaagatgaacaagaagaatgcaagcgtcaatggactagcaatcttgtagaatggcatcttgaagccatcttcaatgtagtctgcactagcgcgatacttgcggtgggccaacataatcaagctgtagataaccaacgtaatcgccgccgtagctgatgcgaagaagttaaaggctgattcaaagattggcaatgcgttgatgattggcgtcaacataatcaagatagctgagaacaacaccgcacgtgatgggattgccttcattgatagcaccttgaagtatgattgccacttccctgtgttttccaaagccaaagcgtaaacatctcgcccggctgagtaaatcaacgtgttcaaggctgacatcgctgctgtcaaaaccacgaagttcaacaacgctgctgcccagtgaataccaatcaacttaaagataaacacgaatgggctttggtttgatggcaagtaacgccaatcataaattgacatgataatcgccaaggcacccacgtagaaaatcaagatacggaatagcaccgtgttgataacttttggcatcacctcgcgtgggttctttgtttccgctgacatcaaaccaacgaattcaattccaacgaacgcgaagaagaccattgggaatgcttgcatgaagctcatccccccattcgggaagaacttgaagttatgcgtgatatttgcaaatgaaactgggccaccatgtgcacctggtgcattgaacccagttagcatcatgataattcccgttgcgataatacctagaatggcaataattttgattgatgagaaccaaaactctgcttcaccgaaaaaattaacggcaaccaagttaaccccgaccagcaaaatcatcacgataatttcgattaaccacgctggtacatttggtaaccagtattgcacgtataacccaatggccgtcaactcggccatagctggcaaaatcagtgtaatccagtatgaccaacccacgaagtgcccagccccaggacctaagtactttgacacaaaggccacgaatgaattgttgtccggatcggcgtaaagcaactcaccaatggcacgcatcatgatatatagaaagattcctgttagtaagtaaacaaataggattgatggtcctgtcagactgattgagtctccggctcccaagaacaaccctgttccaatcgttccaccaatcgcgatcatcgtcacgtgacgctttgataacccacgatttagtgaatcaggcgcggcgtttttgtctgccatgcgctgcccctcctctgaataaatttgctatgatatacaaatttattttctcttttattctctttttattcatcagtcaaaaggcaaacccttaatagcaacgagtaatatcatagcacaccggtgtatttttttgcactcttttttgaatattcgtgcatggttttacgatatatgcattgtgaggtgtatatattcaaaagaaacatccagcgcttggttcgttttaaacgataaaaaccatccaaccatgaagttggatggtttctttattagtgttgtggattgtagttaacgactgaaccatcttcattaataacttgaccgttgtggttttgatcatcaaagaagaatgacaaaatcagttcagcagcattttctgtcgtacgaacgaagtcaccttgaatgtggccgttcaagtcagttgaaacagcgcctggcatcacggcaaaaatctcaacaggcacacccttttgttcgaactcaagaccgaagtccttcgtcatcacgttaagcggtgccttagcagccatgtaaccaagtgggtgccaccacttacctggctcaattggcgttgaaacgttaataatcgttccattgttcttttgtagtactggcaaaagccccttcgtcaactcgtatggaccgataaagtcaactttatagatatcaagcaactcttgtgcttcaaactcccatgccgtacgttccatatcacctgaaaataccggcattgttaatcaacaagtccaacccgtcgtagttcgcgttgatgtttgctactgcttcatggatgctatccaagttagcaacatcaaccaacaacaattctgcattaccaaatgcttgcaactcgctcacagcggctgcaccacgctcagcatcacgtgcaccgaccaatacggtgtagcccttttgtagcaattgcgttgcaatcgcataaccgattcccttgtttgcaccagtaaccaaagctgtcttagccattaataattttccttctttctttaaagctccattattatatagctacaactaacaaaaagtaaggtcttgaaattattaaaaaacctgctctggctggcctagttaatcgtcggttttcctcttatcgtcgtccgatttggccacgcactagcgcgtcatcatatgattttgccaagttcattggaatcgtcattaggaactcagccatatcagataaattaacacctaccataacaacacgacgcttgcggctttgcaaacggtgctcaacaaccgtgtaaagcatttgttcgtcgtgtgtgcgtggtgcaagttgaattgctgacgtggttgtaatcgatgcaatccgttcttccccgtcatctaggtcgttaaagtagctagccgtttcagtcaaatcaaccggcactttgaaacgcaattccaattcatccccattgtacgaaacttgcaccgtgtgcaactcaaacaccccagtgccgtctaaatcatcatttaattcgtcgaccagcggacgaatctcagtcatcaattcacgattgaaaaacttctcagcgctttcagtcgtaccttgtccactcatttggtagcccacatagggatcttcgtgctctgtcaaaatgttatcgacgacgtgattaatgtcaaacttcatatttattctctttcttaacttataaagcaacaatgtttggttcaaatcccatttcttgtacgaatttcataacatcgccagttttgataaaccatgtttgtgtattgtcattgggatgaaaaacgagcgtttccgtcgaaactatctgttcatcaagatagacacgaacatcatgatcaacattattcagtaacccaaagatagaaacactccccggcgttacgccaagcttgatctttaatcgttctggtgacgccatgctaagacgtgtcgactggactgttgattggaatttcttcaaatcgagtcgcacattatcggacataacgactaagtaatactcggtcttattgctgttattaaggagcagcgtctttgtgcgcgttcccgcatatccggcaatcaatttatcagcttcttcagtggtgaaaactggcggatgttcaacacttgtgtaaccaatacctaacgatttaagcttctgagcaactttttcaattggcgtcatattggattcctttagtttttgcttgagatgattagttagttggatttttaattatccctattatacagtccctagtcattaagtagtaaatacaaaaaaacacccaaccaaggttgagtgttttttcagtattgaatagcttaaaattaagccaaaccgtacttcttgttgaacttgtcgaccgcaccatcggcagtagtaaacttttgcttaccagtgtagaatgggtgtgaatctgacgtaacttcaacacggatcattgggtacgtagcaccttcgaactcgatcgtctcgtttgaagtacgagttgaaccagtcaaaagcttgtaaccagtagttgaatcaacgaaaaccacttggtggtaatctgggtgaatatcagccttcatcgtgtttctccttatcgccctagtacattgcgtaccagagtcagtttatttaacctgaatataataccataacttcgaaaagaatggtagtctctcaaccaaagaaatttgcagaatagtcacaattagtgattagcaccctttgcgaattctgtatcatcttcagccttaagcacagccataaaggcttcttgtggcacatcaaccgtaccaaccgccttcatgcgcttctttccacgcttttgcttatccaacaacttggcacgacggtcagggtcacctgtgtgaatctttgaggtaacgtccttacggtatgccttaatcgttgaacgtgacacaatctttgaaccgattgccgcttgcactggaatttcaaagttacgacgtgggatgatttgcttcaacttagccgtaataatgcgtgaacgttcttgggcgaagtccttgtgcacgataaagctcaaggcatcgaccttatcaccgttcaacaagatatcaatcttaaccaagtcagacttgcggtaacctgaaatctcgtaatccaatgaggcgtaaccacgcgtgtttgacttcaacttatcaaagaagtcaaagatgatttctgacaatggaatgtagtacttcacgttaacacggttttggtccaagtaatccatcgtatcgaattcaccacgcttttgttgcgccaattccataaccgccccaacatattcgttaggcaccatgatttgtgcgtgtacgtatggttcttcaatccacttgatggcactggcttcaggcaactctgatgggttggccacttcaaccatttcaccgtctgtcgtgtacgcatggtacgttacagatggcgccgtcgtgatcaattccatatcgaattcacgttcaagacgctcttgcacaacgtccatgtgcaacaagcccaagaatccagtacggaaaccgaatcccaacgcttgtgacgtttcaggctcgaattccaatgacgcatcgttcaattgcaacttttcaagtgcttcacgcaagtcgttgtactttgagttatccgttgggtacaaacctgaatacaccattggcgtcattggttggtaacctggcaatgcttcagccgctgggttcttaactgatgtaatcgtatcaccagggcgtgcgtcacgaatgttcttaattgaagcagcgacataaccaatatcaccggccatcaagaagtcacgcttcacagggtgtggtgagttaacaccaacttctgtgatttcgtattcagctcctgagttcatgaagcgaatcttatcacccggcttcataaccccttccttcacacgaacggtcaaaataacacccttgtatgaatcgtaggctgagtcaaaaatcaacgcttgcaatggggcttccaaatcaccctctggtgccggaatcttcgccacaatttgctcaagcaattctggaataccgataccttgcttagctgatgccaaaacagcttctgatgcatcaataccaatcacatcttcgatttcagcacggacagcttctggatcagcggctggcaagtcaatcttattgatcaatggcaaaatttccaagtcgttttccaacgccaagtaaacgtttgccaacgtttgggcttcaacaccttgggcggcatcaacaaccaaaatggcaccatcggccgcagccaatgaacgagaaacttcataagagaagtcgacgtgacctggtgtatcaaccaagtggaagatgtacgtctcaccgtcgttcgccttgtagtgaacttcaaccgcattcatcttaatcgtgataccacgctcacgttccaaatccatcgtgtcgagcaattgattttgcatctcacgctcagtaaccgtgtgcgtcgcttccagaatacgatctgaaattgtcgacttaccgtggtcaatgtgagccacaatactaaagttacgaatgtgagattggcgcgccttcatttcttgaatgtccattatttatcgcgctcctattctgtctaatttttctgtccctaccattatacagggtatttcggtgcctgacgatagcaaaaagagaccaatccgcctagattagcctctttcaccttacttcttggtcacgtccttgaattcgccttccaagacttgtgccttgttgcgcatttcatggtcgtgacgtgctttacgtgattgcgtgtaaacaaacaatccgaccagaatcaaaataatcaaaaaccacatacttgttctcctagtgtgttacggtccaattcaacattttttgaacatgggcaacatcgggatcatctgagcccccaaacaatgtttcacccgtattcatggtagcaatttgcgccatttcatcagtcgttagttcaaaatcaaatacatccaaattcgatgccattcgtgccggcttcattgactttggaatcgtgctgatacctcgttgtagtagccaacgcaaaattacgtgaccaacttctttgccgtggtgatcagcaatcttagtcaaaattggtgaatggaacacatcatgcatcccctccgcaaacggtgcccacgcttcaaccaagatgccttgttcttggaagtacgccaccttgtctgcttgttggtggaaaggatggttttcaatttggttaaccattggcgcgatgtcgttcaatgccacaaattgcgtcatcaatgctggtgaaaaattcgatacaccaattgcccgaatacgaccagctttgtatgcctcttccaatgcacgccaagcgccccagatatcgccaattgggtggtgcaacaacaccaaatccaagtagtcagttcctagtaattccaatgagcgtgaaacagaagcctttgcgccctcgtagctcatgtcttgtacccaaaccttagttgtcaaaaacaagtcacgccggtcgacatcactctcagcaattgcgcgaccgatatcaccttcattgtcataaatcacagccgtatcgatcatacgatagccgttcgcaatggcatccttgactgcttgggtagcttcagcgccttggacttgcgcaacaccgtacccaagtaccggcatcttcaccccatttgctaatgttcgaaactccattttcattgcctcgttatcttatccgttaataccctgtattatacgcttctgtaatgaaaaaacacggcaaaattgccgtgtttttgtttacaagattggtgtcagcaaacgtgagaacatttgcttaaacttgcgccatcctgactggttatcgaagtattgacgggtcaaacgtgttgaaactcgcaaatctttttcgaaaatccgattcatttcagcagccaaacgacgactgtacataaaggcattcacttcaaagttcaaagcgaatgaacgaatatccatgttggcactaccgactgacacaatcttatcgtcaatcactaacgtcttagcatgcaagaagcccttgtcatacgtataaacttcggcccctgctcgaaccatcgcacgcgcatagtattctgtcgcgcgataaacaaacggatgatccggcatgctcggaatcataatgcgcaccttaacccctgaacgcgcggccacagatagcacatccataatcgcttggttcggaataaagtacggcgattgaatcgtgatactttcacgggcaatcgccagcatgtgcaagtatccttgataaatttgcttcgagtccgactccggtcccgatgagacaatctgcatcgcaacatccccagcctgtgtgttgtctgggaagtaatcatcactgaactgtaacttttcttcagtggtcgtcgcattccaatccatgaagaagcgactttgcattgccaacactgcatcaccttcaacacgcaaatgcgtatcacgccagtagccgaacttctttttcttgcccaagtattgatcaccaacgttaaagccgccaatgtaaccaatattaccgtcgataatcactagcttacggtgatcgtgattattcacacggaatgaaaagggttgccaatcatgaatcaagaacgtttcaatttggccaccggcttcacgcaagcgcttaaacatcttcttgtgacggccacctgaaccccacatgtcataaatgacacgaacgcgcacaccttcagctgctttcttcgtcaataaatcaaccaactgattaccgatttcatcgtcataaattgtgtagtactcaacatttacgtgatgcttggcttgttcgatatccgcaaacaattgggcaaacttctctttaccatccgtgatgaccgatacgtgatttttatttgtgaaaattgcttgctcattattcaagaacaggcgaacgaatgcctgttcttcttgataatcagccgtggcaatgtgcgccatttgcttcttttgcttcttcgcaatacggtctatgcccatgacgcgttgcgttcgaatatcaaaaatgcgcttatttgatagcttacgtccaaagaaaaagtaaaatgcgaacccaaaaactgggaacaacaacagcaccagcatccaagcccataccgtcgtgatgtcacggtttcgatcacggaaaaccgtgacaatcgctcctagcgtattcgcaatcaacaagacgattagcgcaatatttatccaatgttctatcattgctaatccccactttcctaccaactcataatcgtacatctattgtagcagtaccctgaatgaaaaaaccagtgcagtcacgcactcgttacattttcatctaaatcttaacaagaagttagccaacattttcggcaaattgtgaattatacaactttgcataggcgccattcgcagctaacaactcatcgtgcttaccacgttcaacgatattcccatgctccatgaccaaaatttgatccgcatagcgaatcgttgatagacggtgtgccacaacgaaactggtacgaccagccatcaaccgggccattgcatcctgaatcatccgttcagtacgcgtatcaaccgaacttgttgcttcatccaaaatcaaaatttcaggatccgccacaaaggcacgcgcgatcgttagcaattgacgctgtccctgcgagatattggttgcttcttcattcagcaccgtatcatagccatccggtagcgtcttaatgaaatcgtccgcgtgggccatcttcgccgcttcgtagatgaaatcatccgtcgcatccaaacggccataccgcaaattatccataatcgtccctgagaacagccatgtttcttggagcaccatcgcaaagtgatgacgcaaggactggcgactcattgacttcgtatctaagccacgcaaacgaattgtccctgacgttgtgtcataaaaacgttccaacaggttaatcattgtcgacttacctgccccggtcggcccaacaatcgcaaccatctcacccggcttcaccgacatattataatcggtcatcagtggctgatcaggcacataactaaaggccacattttcaaaggtcaccaagtcatccgtttcaatcggttcgactggttctggattatccatctctggctcatccagaacttcaaaaatacgctcagctgaggccacagtcgcttgaatcgtattcgttaagttagcaatctgggtgattggctgactaaactgattcgtatactgcaacatcgcttggacatcacccaagctaaccgtacctgacgccaccttaataccaccaattacggccatcgcgaggtaatccaagttattgacgaaacgcattgatgggaaaatcaatgttgaaacgaactgagccttccaagctgacttgtaatacgtttcgttttgcgcatcaaaatcaaccatgacgttcttctcttggttaaacgtctttacaacggtatggccggcaaacgtttcttcaacttggtcattcagtagaccaagcgacgcctgctgacgagcaaagaaccgctgtgacaacggcgcaattgttcgcacaatcaacaatgaaattgggactgtcgcaaaggcgaccaatgacaattgccagctaattgtcagcataaagtagataaccccaacgaacgttaaggctgatgtcaccaactgaatcaatgactgatttagtgttcctgagatattatccatatcgttaacaacacgcgacatgatgtcaccgttttggtgcgtatcataatacgacaccggcaacttcgtcattttcactttgaaatcttggcgcaattgatagactgtgcgttgcgcaatccgggtcatgatccattgctgtgtgattgagaaaatggcactcaagacatacaaaatcgacacgaataccaaaatctggaataccttatccatgttaatgtgaattccggtatgcattttcaccgatcgtgtcacgtcattaaagataactgttgtcgcttcacccaaaacctttggcgcacgaactgacaacacaactgataccgctgcaataatcagtgaaaaaatgaccccagcgcgatccttacgcaagtacttaaacaagcgaatcacagtcggccagaagttcactgccttttcaacggggcgtcccatgccgccacggccaccaccgcgaccgccactagtataactacgcatcgacacccacctccttcaaatccgcttcagacaattggcttcgcatgatttcttgatatgctgggcaagtcttagccaactcttcgtgcgaaccaacgccggctaattcgccattgtctagcaccacgatgacgtcggcattcataaccgtcgcaattcgttgcgccacaatgaccttaagagccggtgccaaacgttcgtcagcattaatagcagctcgcaaacgtgcatccgtggcaaagtctagcgctgagaacgaatcatcaaacacatataccttggcgtctttaatcaaagtacgggcaatcgccaaccgttgacgctgacctcctgagaagttagccccgccttgctcaaccgtcatatccaagccaccttgctcttgaataaaatcatctgcttgtgcaattttcagagcatcccaaatttgttcgtccgtcgcatatggcatcccgaacgtcatgtttgagcggaccgttccagtgaacaatgtcgctttctgctgggtaattgacaccgcctcgtgcaaatcatgttgggaaagctttttgacatcaacccctgatagttcaacgtgaccaccggttgcatcaagcaaccgcggaatcaaattgactaacgtcgactttcctgaaccggttccaccgataatcgccattgtttgccctgctgttgcctgcgcagtgatatgactcaaagcggtgcgttcggcaccttcaaaacgatatgacacatcgttaaatgccaatgatgctggtccatcaggcaatgccaccgtttgatcagcgtccgtaatcgtgtcggctgagtccaagacttcattaatacggtccgctgacgcttgggcacgtggcaccatgacaatcaccattgatagctgcatgaaactcatcaaaatttgagtcgcatacgtcaaaaatgccaccaagtttcccattggcatcagatcagcgccaatcagcttggcgcctaaccacacaatcccaacgttggtgaatgacaaaataattgtcatcactggcatcatcatcgctactgttgtgaagacgacacgcgccgtgtgcgtcaaatcatagttggactctttaaacttatcaacctcgtagtcatcacgatcaaacgcacaaataacacgcacacctgtcagaccctgctggaaaatcagattgattttatcaaccttcttttgcatcgtcttaaaacgaggcactgaaatgcgcatattgataacacagcgagtgccaaaacaggcaatgcgaccgcgaagaccatcgttaaccggtggtccaaacgccaggccatgatggatgcccccacaaacaaaagtggtgacatcagcatcatacgtaagacagtttggaacacgttctgaatttgcgtgacgtcattcgtcgttcgcgtaatcaacgttgcatttccaaacttatcaacgtttttcgcatccataaacgtgaccttgcggaataacgcactacgcaacttcatccccaaacgctgactctgagtcgccgcaaagaacacattcaaagcagcacccgaccagccggcaatggcaatcaacaacatgatgccacccatacgccagatatagtcaatatcgttttgggcaattcctttattaataatgttcgacgtaattgtcggcaaagacaaatccgccgatacttgaaccattaaaaacaacaccgccagtatgactggaatgggttgtaaatatcgttttcctattcgaaacataatcattcctcacgttctgttagacaccgttagtttactcgcctttttcggataataaaagaaaaagctcatgtacgcaccatgagctttgattatgtttacttgttctgaccaacaaactcccagaagagctcgcttgcctttgaatgttgggctgtattcttacgcataaaggctaattgactcacatcattgaggttaatcggacgcttgatgatatcaggattagctgacatatcaacactcttttccatcatgattgagacacccataccgttcgcaatcatatttaagatgatatcgatacgttgcccttcatacgccaccttcggctcaaacccagcagtacgggccatcgtcatgacgcgattataaatcgttgtctcacgcccaagcaacaagaattcttcatcttgtaaatcgctaattttaacctgtgtcgcatcagccaaaggatggtcttttggtacaacgcaaacgaactgatccttatctgtgacgatggtttcgtacttctcattaatatcaccgaagtcacgcccaaacaccacatctgccttaccgttgtccaacgactgagtaataacgccgtgatcaacttcagataggtgcagtgatatttcgggatacttatgatgaaatgcggcgattaactcaaacccacggtaattagaaactgatggaatcgcatgaatcgttagtgtattctccgattctgccgcgtgctgattaagtgtgcgcaacatcgcatcatattcggacataattttagctgcataaatagcggtaatgcccccagcctcagttaacttgatggtacggtgactacgttcaaacagcttcgtatccaattccttttctagcgctaagatttgttttgagatgttaccttgcgtcgtgaataaacgttcggcagtctcggtatagcttagcgttttcgccaaatctaaaaatacctcaaacttatggatatccataatacgtcctcttaaatattactctttggaatagtttatcacatttttggatttgttgcgtttacttatcaagcgtaagatagaaatatcgcattttatcacggctgctattggtctaaacccctggctttagccaggagtaaagaccaaggacgcccctgataagggcgacttggtcacatcgaaggtctaaaacctccgatgtttccagtctactttatggaggtttagagagaatatgaatatgcctactggtattattattaatgctttgtccgttttagcgggcggtatcgtcggtggccttttcggtaaccgcatttcagacaagtttaaaaatgaaattaacatgattttcggcgtcgcttcaatgacaatgggtgtcatcgccattgcgccaactaagaacatggcgccggtcatcttcgctttgattctcgggacatcactggggttgattttccacgttggtcaactggttaaccgtggtgctgggtttatgcaacgtcaaattgctcgtgtgattccaatgaaatcaagcatgcctgaggatgaattcatggcaaccttgttgacagttatcgtcctattcaccgcctcaggaactggtatttacggatctttggttaacggtatgactggtgatgcgacaattttgatttctaagtcaattttggatttcttcacggcaacgatttttacggctaaccttggctttgtggtctcagtaattgccgtaccacaatttattttcttctttattctattcttgctagctggcttcatttacccactaacaaacccagccatgattacggactttaaggccgttggtggtgtgctaatgctagccacgggattccgtatgattaaagttaaaatgttcccaactgcggatatgattccttcaatgatcattgtcatgccacttagctggctatggatgacctacatcctacctgtattaactcattaaacacaaaaaaccgcttaatccacaagttgtgaattaagcggttttattattcaactaattacttttcacacaacacccgattaattcaaaggcggttgcctgatttgtaatcgaagcgagcttcgattacttttcagaaatagctgcgatacctggcaaagtcttaccttccaagtactccaatgaagcaccaccaccagttgagatgtggctcaattggtcagcaacaccgagttgttgaacggcggcagttgagtcaccaccaccaacgatagtcgttgcaccgttctccttagttaccttaaccaattcttcaccgatagccaaagttcccttagcaaagttaggcatttcgaacacacccataggtccgttccaaacaacagtctttgcgtctgacaaaactgacttgaacaattcgattgacttaggaccagcatcaagacccatgtaaccatccttgataccatcttcagcaatgtacgtgtcagcatcgttagcaaacttgtcagctgctacggcgtcaacaggcaataccaacttgtcgccagcttcttcgatcaattgcttagccaaggcaaccttgtcttcttcaaacaatgagttaccgatagccttaccgttagctgcgtcgaacgtaaatgccattccaccaccaacgataaccttgtcagccttcttcaacaagttctcgataatcgtgatcttgtctgaaaccttagcaccaccgatgatagcaacgaatggacgctctgggttttcaacggcaccacccaagaacttgatttccttttccatcaagaatccagcagcagtttgtgcgatgtttgaagcgataccaacgtttgaagcgtgggcacggtgagccgtaccaaaggcatcgttaacaaagacgtcacccaatgaagcccagtacttaccaagctcaggatcgttctttgactcgcgcttaacttcttcaccgttaacaacgtcttcgaaacgcgtgttctcgaagatcaaaacttgaccatcttccaaaccagcgattgcgtcttccaattccttaccttcagtagcaggaacgaaagtaacaggttgacccaacaagtcagccaaacgttgtgcaacaggcttcattgacaagcccttcttgtcatcttcactcttgatacgtcccaagtgtgagaacaagatagcgcgtccgccgttatccaaaacgtacttaatagttggcaatgcagccacgatacggttgtcgtttgagacaacaacttcaccgttctcttccttcaaaggaacgttaaagtcaacacgcatcaaaaccttcttacccttcaattccaagtcttcaacagtcaacttagccattgcaaaagtccttctttctgtgtgtgattgcttttaataaaaatcaatatctatattatatcaaaaaacaggtggttcagaatgtctaaaccacctgtttttactctatctactagaaactagcaattagagagttgccaagtgcaacaacgtacggatcatgtttgaagtgaaaccgtattcgttgtcgtaccatgcagcagtttgaaccaattgcttgtcaccaacagtgatgaccttagtcaaagttgggtcaaatacagcaccgtgcgtgtcgccgatgatgtctgatgaaacgatttcgtcttcgtttacaccaaatgagtcgttgacatacttcttaacagcgttgttaacttcttcggcagttacagtctttgacaatacagtcgtcaactcagtaacagaaccgtcaacaacaccaacacgttgtgcgtgaccgtccaacttaccagcaacagaaggaacaaccaaaccgatagccttagcggcaccagttgagtgaggaatcgtgtttgctgaagcagtacggtttgaacggaactttgatcccttaggaccgtccaagatcatttgcgttgaagtgaaggcgtgaaccgtcgtcatcaaaccgatctcgataccaaattccttgtccaatgcgttagccaatggagccaatgattgcgtcgtgcatgaaccagctgatacgatgtgatcatctgaagtcaaagtgtcttggttaactccgtaaacaaccgttgggatgtttccagctggagctgaaatcaagaccttctttgcacctgcatccaagtgagcttgtgacttttctgctgaagtgtagaatccagtagactccaaaacgatttcaacaccatcgtttgcaacccacttcaagtcagctgcgttacgctcagcgtaaacgcggatcttcttaccatcaacgatgataccttcttcgtcagctgaaacttcagcgttcaaagtaccgtgcgttgagtcatacttcaacaagtatgccaacatagcagggttagtcaaatcgttaattgcaacaacttcgatgtcgtccgcagtatccttcaactcaaggatgcgacggaaggccaaacgaccaatacggccgaaaccgttgataccaatcttaacagtcattattaagattcctcccagaaattctttgtaaacgtttttacgttgtctattatacgactttgtataaagtttcgcaaacagttgtaacaacgcgctttcaacatcgcaacaaatatgaaatttgttacgaaccgagtcgatcttttgtcctgaaataaatcaaaactcccaaccaatcgatatatctattatacgccactagcttaaaaaaagctcacttttgctttgattaagaacaaaaatgcccaggattcgctcctgggcatttgttactttttcatagaatttacaagacgtcgctttgtacggcggaacgtcgttgacatgaagctcgtgtgcaattcaatcaacgtcaaaataacaagcaatgtcaccgttccaatgactgaaaaccatgtccccgtcatatcaattaatgaacgttcgtcacggctagccaatgaaattgaagaggccttcacaacctcttcctctgacaaagcttcgctaatcaaatcgaagtctgccataccaatcatttgttgcaacgtaaatgggtcgttcaacgattggaattcgtgcaagttttcttgcaattgatcttcttcactcttcaaacgatcttcccaaccatcacggtcgttatcaaaaatcgttagcaaacgaatctcgtgaatcaaaaagatgtaatcagcgacatattggtaggcggcttgttctagagacaacaaaccttgtgccatttgtccttggtgatcgctcaattgatgggttgccttcttcaaagcatctacgacatcagcttgtgccttaaagcgatcgcgcatactatcgaccttccccaatgcggtcgtgtatgccgtatacatttcttcattatcaggtgtatccgccattggtacggcagacgtttgtgcgtttgtatcaaacactttcgtctcttccccgtatgctgttacttgcatgcctagtgcgacaataaatgtcacaactgccataccaaccttttgccactttttcataacattcatgccttccatttctctcttgtaaaagaatagcaagacatttttgatttatttggcttaatttatgacgaaattccagaaaatgtgaatttttattgtagagtatcccaaaacaaaacgcacccggcctcactgaaccagatgcgttagaaacgttgcttatttttgtaaaacaattcggtgtgcttgactagcgttcgcaccacttaaacgagctaatgcataacgcgccacacgccccaatcctcgtagcacgtgcacaccacgcaaatcccaaatgaaatcaatcgcagttgctaacgttactaagatcaaccatgcaatcgccatcaaaatccccaaaacaaatactccattccatgctgcaatcataacattacctcccacgattaatttaaacctagctgtcattgttaattaaagtcctaaacgtctatcgcttaggacataatttattatatattaggttttaactaatttcaaccctaaagttaggttttaattaacggtaactaatacggtccattgggtgggctgcattaaaggcattaataatctcaagcatgtctcgacgagtcgcacccttttgggcgtacttaaccgctttttgcttatcttttgagacatttgatatgtgttgattgaaaatgcataccgtaacgttggttagatggtaaagccataatcgattccttctttcaacatgttagccaggtagtaatccacgacgctgataataattaaccgtctcatcagcaaagtcacttggataccccaaatgttcttctaacatccaagctgcaaatggctcatctgagtgttgacgggcaatacgcattaactcttcctccgaagtcatgtaggcaatgacttcttcacgtgcgttaacctcattattatgagcacggacagcatcatagtccaagtggtcccctaagtcagaaatagcgtgatgatactcttcgaccagcgtacgcgctttatcaaacgtatctaattcacgatcaataaagatataggccttgttccgctttaggtaggcaacaccgtctaatcccgaattttcttttaatggcatcgtatctagaatgataggttctaatccgtattgcgttaaatcatcctctacgcgcattaatagatcatcgtaatcattacttcgcattgcgatcctcgtagtcagcaatcaatccttcaatatacgctttggcacggtcgataacacggtgacgatcttcgtctggtagccctgaaatatccaggccccagtgtgctgccatcaaaactggttcatcagttgcaacggccgttgaaaccttatctgggtcttcgactaggtctgactttgacacaccaaagtattcagccattgcttcaatcttatcgatgcgtgggtacgtcttaccgtttgaccagtcagaaattgttgccgttgacacaccaacgatttcagccaaacgggccgctgtaatttctcgttgcttgattaggcgcttaatgtttcgccccataatctccttaccttctgatgatgccataattttcacctttttcttgtttgtgtttttaatgtttatttcagtcttataggtattatattaaaggtaaacttaacaaaacgcaaggttaaacctaatcttttttatgctattgcgcgctataaaacaattgggctatactaaataacgtattggacttgtagtgtaatggatatcacgtcggattccggttccggagatgagggttcgattccctccaagttcatcatgcatgctaaaaagaccgagatttaaaatctcggtcttttttctatttctatatattacttagctaccttcgcgtaaccggtgctgtagttaatcacaactcctggctccacattaggaacgaatacgttaaactctagtgatccgtctgatgacttggcctccaagtgtgaaccagatggtaccaagttatcaccatcgtaaaccggcgttacacggtaacgaaccgtcttacgattatcttgtgcgcgtcgaacctgggtctcgtaatagttttgacccgtgttgctgtcattcccatttgaggcttggttagcccacgccgtttgtgcggtaatgttttgtgggtttgcttcagaagcatcaaaaccacgaacgcttccagccaacgcgtaaccaattgaatgtccacggttatagagcatcttgtagttaccaccaattgatagttggtgccacccaactggttgcatttggcggctgttacccgtctggtcacgtgattgatattggcgactcgcctttgttagtagcgcattggcaacgccggcacgtcccaaggaatcttgcttagcaagttgcacgtatggcgctgaacttactttagcgttcaaatcagttttattatcgttaagaataaacgcaccgttaccattaaaacgcacgttattcgtgcccaattgcttcaccacattggcagtcaaaactgatgatgccaatgactcatttgggtgctcatctgatgtgctaccgtaattaaccttcgcatcagactttacactggattgtgcataatttgtcttcgttacttgtgtgccattgttatcctttagaacggtttgttgcaaagcaaaaacacctaatgcaatcacaacacctgctacagatacttgtcgcttacgtcccatgtcaaaaactccttctcttatatccctgagatattattataccagtaagttctacttaatattgtctttgaactgtcaaaagttgcatgttatctggtattattagggcaatcaataaatacaaacgaggatgtcattatgacgaacaagaacttgattgcaaagcaagaattgtcacaccctgccgactggaagcctgaagctgcccacgccgacgtacgtgcgcaaattgaggatgccatcgccaagcgtttgacggaaatcatcgcaactgttgccgatttcggtttcgaatcagcgacggtcaacctacacgacttgcaagacttcgtgcgtgatgtcgtaattggtcactaccaattccatttccgcaagaaccctgctttgcgtgaacaacttgttttggcaaacgaaatgccactttcagttttcaacacgctcgttcaaagcggcgtcgctgatattttggataactcagatttcgaatactcattccacactgacggtgaagttcaaattttctggaactaaacttaaaaaggcgtgaacaaacaaactgtttgttcacgccttttctatttccgattgcctggcattgcttgattgttaggcaagacgtactgctggatcaaatcaacaatttgctgattttgtggcaaatcagaatgctgggcatcatccccagtcaccgtgatttctgtaaaatgggcgacctgtttttggaaaataaattttccagtctgcactgactgttctggcacaatgccatcatcgtcataggtttcagttcccataatcgagtataccgttaaatcgctcggcaacttttcgcgtcccttaataaaatcttgtagcatttgcgtacgattcttagggttcgtttcctcaaagttatacggtgttccgatggtcattaacacttgaacgtgctgcgtatcactgtcatagtacttttctaaaaaacgggtccaaatcaacccaccatttgagtggccaattgcttggaattgtcgaaaccgatattttttctgcaacatttgcaaagcttcattgaaccagttggcttgctttttaatattgctataaccgtcgtgattattctcaaacgcaatcacgaaatacggtgctagatcaccgctacgcactttaccggttgtgaccattgaattatcagtcttaaccgtcacctttacaagactgtgcttgttgtttcccttattcagttgattaatcagttgatcaaatcgattctgtgatgcggatgatcctggaattaaaattgtgggcgtcatgcatgagttgaagattcgttgattcgtcgtcgttttactttgactccaacgtagaccaacaatcgccatcgtaatcaagaggacgctcagcagccctagtattaacattaaccagcatctacgcataggcgacctccccactcttatgtagttcttgtacaacacgccagaagataaccacatccagcgctaacaaaccaatcattacaagaacatacaacaacatattatgtgatgccaaaccaccaaatagaattgtcggcgtacctgatggcacccagtacacagctggcgcaagatgaagcgctaataataacgcaccaatgccaaggttaaccgttgacgcaatgagcattgtctttagaacccgccagttccacataattggtagcgcaaacgcgagcgcccaccattgatcaaagaacgttggaataatggttaaaatcaatagcactggcaacggcttattccgggcttgaattaagtatgtgattaacaacgccaacatcaagcccgccccaccaaaccacacaaatgcggatagtgggtataacgagaatacgtgcggaatcgtctgatgttgcaaggcagctaccaagttttcgttcgcagccgtcgctgaaatatcaggtcgaataacaccggcaacagcgtttaacccaaaccagttacccaagacagctattagaacccacaaccaggtttgccataactcagttgaaccatctccaatcaaggcaactaagccttgttgtagcaagccaaacaaagataatttcagccagctatgtagcgtcacggcgtatgcaccaatgagtagcgtgactaaaatcgccacaagataccgatgtcttggcttaaccaattgaattggtaccataatggcaaacaccatcaacggcaataccacaagattcattaggcttgccgtcgtattcagcatttgccaactcactaatgtcaccagggttagcaaaatcgtttgttgatggccttgaaattcatcctgtaatcgtttttgaatggcaagaacgatgaccaacacgcccatgatttggaagcctttatctaaaaacagcgtcacaacacgattaatctcgccaaacgacgacatgatatgacgaccataaccaagtgtgaccgcaaaataaccatctggtcgcaggaataattgttgcatcaaatacaaccaggttaacaccaacacaagtggcagcatttgttgcatagcacgccggacagcctgcatattttctctcatgctcctcccatcctttcgtttaactaggaatgttgtcattataagtggtcaaaaaatggcgattagacatcatatctaatcgccattattctaccaccacggctttcattaatgcttattacttaaaagaattaacatttttcgccgtggtccagtcttcatcgaagaattgatcattcatatcatacgttggtgtcttgcttggcgttgttaggaagtggttcacttccttgtccattgctaaccaaccacgccaacctaagtgaatggtatcctgcataaagtgtgccttcccaccatcctgtgagaagtccgcaatattcgtaaagccttgtgaggtcaattggtaacgaattttcgctaccgcctcttgatacatgttcatatcaaggcccgtatacttagcccacttttcattaaccggtggaattacaaacagaacatttgtcttcgtcttagcaaattgttgcaaagccaactcaaagtccccatattcaggtgaacttgtgtaatcaaatgacttttgtgaccctgctaactgcttaacgtgcttggcaacgcgttgcttataaaacgcattatcaataccaaattggttatttgtcgtacgcttagcagccagcttatcagctaacgcatcaagcttttggttatcatagggttgcggcaaaagcttcgtcttaggcaaaatcttcttttcgtagttattacccaattggaagtccgcaaacaacgcatcttgatgattgatgaagtctaatcgaacagcaatcattttctgatcaccactagatagcttttcaccctttgcaatcttcttcaagtaacctgtcaacgcgctcgaaacgttcatttgtagcaaacgcttggctgcgtatcgatcagttggtgtgtcaccagctgtttttagccaagtcaacgcttgcgcctgactgaagtagtacttgaacgcagctggatcctcgccttgcttcacaaaccattgtggtgaaatcacataaacagcttgcttgccttgcatttgcttgctaatttgttgcataccgaagtattgcgtcaaagattgcgccccacgttgtccaagcaaaaatggtcgatagtcacgatcataagcttgggccagcactgacgggtgcaaagaatccatacggctccactcactcgaaccaaagaatggtacaaaacggtgatttggatccgtcaaggcacgttgcttcaacgtttgatttttaaaaactgtcggtgtcaaggcattggcagcacgctgctcatcttgaaaattgtgtttgttggttgacatgggtgccaactcaatcaccgcaacgacaagtacaaaagctagaatgacaggaccaaaaattagtcctaatcgcttaagcattgcgcaactcctcgataccttcaataatcttgtttgcagtattccagtcgtcacgacccatttctgaaactggcaccttaatgttgaactttgattcgatttctagcacaagctcaaccgttcccattgaatccatgataccggcatcaaacaaatcttcatccatcatgtcggaaacatcttccaagaacaaatcgttaatcatggcaatcaattctgcttttacatccatttttatttaccccatttttaaactgtaactgttagtgttggtggaaccaaagttggttcaagaaccctgagaacaacaggaaactcaacatcacgacattaaacgtgaagaagatggcaaatgcctcggtaaacttgttgtgtggcacttggcccttgtggcgcttcttgtaacgtaaccaccagtcatttacgaccaaggcaacaccgtggaacacaccataagaaatgtagtaccaagttacaccgtgccagaatcccataatcgtcatattgatgatgtaggcaactcctgatgtgacattacggttcttaaagactttgttgcgcatcagaaccatgaccaaacgcatgaagatatagtcacggaaccaaaaactcaatgacatgtgccagcggttccagaagtctttaagattcttcgccataaatggcttatcaaagttaatcggcgtttcgattcccatcatgtatgaaatggcgagggcaaacaatgaataccccgcaaagtcaaagaacaaatcgaatccgtatgcgtacataacgcctaacgtaggtagattgaacagtccaccaacacgtagcgcctgttgctccaaaggtggcaacaacaatgacccaaaaatataagccaaaacaaacttgtacaagaatcccaagaacaagtacttaaccgctttttcaagcattcctaaatacttttcgcggtcaggtacattttcataatcttcattaaagcgacggtagcgatcaattggtcctgatgacaaggttggcatgaacaacataaatcgcatgaattgtggcaatgtaaattccttcagcaccccatcacgaatttccataatcatgccgactgagcggaacattaaatatgaaatacccaaaaatccaagcaaagaattttgaccgttatcgatggccggcgtgatttttacaatcgccaatggcaagatgtctaacaagacggccccgtagaacacccacttgttatcggctcgcttgcgatacgctgcataaccaaacaccatcaccatttgccaaataatgtagccaatcaacgcgatgaactgttgccagtgtgtcccagcaaacatcaacacgatgaatgctaatgacactaggccttcgtaccacttaattcgcttaccatacagcatggcaatcacaattggcactaacgccaaaactaagtacccaaagtattgtggatcaccatatggctgccaatttggcaatgctttaagccaatccatcatcgattgttaacctcagcaatcaaagccttgatgttaatcttaccgtttggcgtaattggcaagtcatcacggtacaagaaacgtgatggcatcatgtaaggcatcatatcgtccttcaagtcttccttgatggccttcgtcaattgcaaatccttttcgaatagctcacgaacacctggctttacaacaacgtatgccaacaagttttgcaccttgtgttgatcgttataacgtggcacagccaccgctgactcaacatattgtgacaagttcaaaacgtgagaaacttcttccaactcaatacggtaaccgttgaacttaatttggaagtccaaacgaccgccgtagtgcaacataccgtcttcgtcaaagaatccgaggtcaccagtgtggtacgctggttgaccatctaattcaaagaaggcagcggctgtcttttcagggttgttcaagtatccctttgacacagctggacctgagacgatgatttctccttgctcaccaactggcaacttgttgccttcttcgtccatgacaaaggttggtgaatcaggctttgggaaaccaattggcaaacgctcagccttttcaatcattgctggcgtaatcgccacagctgacaaagcaaccgttgcttccgttggtccataagcattcacaatgcgtgcttctgggaagcgctcgtgcaactttgctgctgtgcttaccgttagctcttcaccatcgaagtagaagtacttaatttgtggcatcttttcagccgtaaagtcttctgacaacatggccatgtccgcaaatgatggggttgacgtccaaacttgaattggcaaatctggcaaaactgcgaacaactccttgaagttctcggttacgtgctttggtagcgcgtataacgtaccacccattgctaacgttggtgcccaatacatcactgacaagtcaaatgagtatggtggttgcgccaacatttgtggttgctctggcactgagaaatcatccgtgtttagcatccagttcgtgtatgacaacaagttgttgtgtgaaatttgcacaccctttggcaatcccgttgttcctgaagtaaagataatgtagtaattatcatctccttcaacagcgtgcgtcatctcatatgaggcacctgacttaaaggccgtttgtagttgatagatatcaataactggcacatctgcaatctcaattggcaacggatcaaccgcaatcaccaagcttggctttccaattgacaaaatgtttagcaaacgctcattagctgagttaacatcaactggcgcataagcgtggcctgacttgctcaaaccaacaaaagttgccaacatttcatattcttgaccaccaaacaccataaccaatgacttgtctggtagatcaagtgaatcaacataagctgccaatccatctgagtcgcacttcaaatcagcatatgagtgcgtctcacctagcacattgtagacagccatatctggttgtgtttgtgcgtatccatcaatcgtcttcaacatgttcgtaacttgcatgttactaagcccccaaaaaatctcttatctctagaattcgttataaataaagtgtccttggcctaaacctgaatagccgtataaatagaacaaaatcatcaatacaactgcgtaaaacagcgtttgcaaaacaaatttcacaactggctgctgactcattgccaccagcttttcaatcatatctaaacctctcacacatatttctgtctttttcgcaacataaatgtcacaaaagtttcatttgttattttagcacgtattcataaacgaaccataaaattcgcctttttcaggagtttaattttttggtgttttcggaaatttagtaaaaaaggaccgaaatcctaaaataaagattgttcggttccgaatgttaattcacttttttgttgttatattgcgtaatttcaatgccagcctcagacaacgccatgtgtgcaattgaaccattttcaggtcgctcgtgcacttgaattttaccttgtccataacggtcagctaatgaaataagtgtatttccgtgactgattaatagtactgtatcaccatcttgcaattgctcgttggctaaaatttgtgcaaaaccgtcatcaacacgttgccaatactccgctgcattctcagcgtcatgccaaggatcagcgtccttcagcaagtcctttgtcttatcgacaccatatgcatcaacgatttgtgcatacgtcgtcaaaccaactggtgccccggctgccgtccaagcgacatccatattgctcccttcaaagctaccatagaactcttcacggaaatgccaagacgtcgtcaatgtgacatccccagacgctttattggctgccaaaatatacttagctgtatccatcgcacgggttgtatccgaactataagctgctttgaatgaaacgttcgccagcgtctcaccaacgcgttgtgcatcagcaatccctgcctcagtcagtggcgagtttccccatccttgcaacttgttatagcgattaaagtacgtcttaccatgacgcacaacgatcaaattaattgtcttcatgctaaccgtcctttcaacgccattatagcaaacttactttttacgttccaagacacctttacgacgacgaatttgttcaggcttaaggtgtgaacggaaaatttcaaccgcttgttttgccttagcgccaacgaattcaaactcttggccggccgttgtcttaacaaagaaaccacggtaatagaaattcaaaaagatttccatgctgactgattcaacattatcccaaggaatttggacataaccaccaccagcgttagcacggaattccataccacggtcaccataaaacatacgcccctgtttgatgttaaccggtgacatcatcgcatttgcgttaccctctaaatcaatttttgtattaagtgcttgtaccataactttttcctctactattgatatgtatccccttagttaggggattgttttaatttagttggtggtgtgtgtccgccaactcttttctaactaaaaatggtagcaggcgtttccgcctcctaccattttagcaaacattatatcgttcgaatgattatcccatgataccaagtgcgtaagccaagataccaacggcgaacaatccgaagatgattgtgatagctgatacgcgcttacgtagcaaccacaataccaagaacaacaatagcaatggtgccaaaccaggaatcaattggttcaacgtgtcttgcaacgtcgtaatcttgtaagcacccaaagtttgaccaccttggatttgttgtacgatttcgatcaactttgatactgaaacgtgtccgtcgttgatttgtgaagccaagcttcccatatcaacaccagcaccgtcttgtaccttaacctttgaaacaaccaatgggaagttcatcgtcgtccaacgaggaaccagcacacccatgataaacataccaaggattgatgcacccatcgtaatcttttgcatggcaccaccggccaagttttgcgtgatattagttccttgcttgtaaccaaggtcttgtgtgtaccacaagaatcccatacgcaagacgttccaaacaacgaagaagatgattggtcccatgattgaaccaccttgcgccataccagctgcaaaggctccaagcactggacgaacagttccccaccagattgggtcaccgacaccggccaaaggtcccatcattccgaccttaacaccttgaatcgtttcgtcatcgatatcagcaccgtttgcacgttgctcttccaaagccatttcaacacccaagattggtgaagccacgtatgggtgtgtgttaaagaattccaagtgacgcttcaaagctgcggcacgatcttcctttgatgagtacaacttcttgattgcaggaatcatggcgaatgcccaaccaacgttttgcatacgctcgtagttccatgaaccttgcaagaagaatgaacgccaccaagttgcacgaagttccttcttagtcaagtgaacttcattctttactaattcagacatgatgttattccccctgctcctagtagttgttcaaaatggcatcgactgggtcgccaccatttccgccggcagaaccgccgccgtttgatccaccaccgttaccgccgttaaactttggtgacaattgtaggtaaatcaatgcaagtaccaatccgatgatacccattgcaatcaagttcaattctgtaacagctgatagggcaaatcccaagaagaagaatggccacaactcagcagttgccatcatgttaataaccatggcataaccaacaaccacgataaatccaccggcaacggccaatcccttagtaatcacttctgggatagcgttcaaagcggcgttaacaggtccggcaccaacggccataacgattgccgttgggatagcgatacgcaatccttggaagaccaaagccaaccagtggacacgctcaacacctgcgatgttacccttttcagcttcgcggtcagcgacgtgagccaaggcaaccgtaatcgtacgaacaccgatcgtcaagatttgtccggcaacggccaaaggaatagcgatggccataccagtcttgatgtcaacttgtgcaggtccagtaaccaagtaagctgaaacaactgatgccaaagcggcatcgggtgcgatagcggctccgatgttcatccatcccaaagccaacatttgcaacgttccaccaaggataacaccttccattaggtgaccagttgccaatccaatcaacgttgcagcgaccagtggttggtggaattggaactcgtccaagattccttcaacaccggccaagaatgcgattagaattacgaaaaacgctgaaatcatgcgttcatcctcccaaataatttcttagcaataatatagtagttattcaattgtgattacttcaacaagtcgaagatatccttgctttgatcacttggcacctttcgaacatcgaaagtgataccttggtcacgcaagtactccaacgtcttcacgtcttcgtcgtcaacggcaacggcgttcgttaccatgcgcttaccttctgagtgagacattgaaccgatgttaaccttgtccaacttaacgccacccttaaccgctgcagcgacatcttgaggtgtttcaaacaacaacaaggccttaactgaagcgaaacgtgggtcatcccaaacatcaaccaacttttgaattggcacaacgttaacctttacaccaactggtgcagcttgtaccaacaatgtcttacgcaactcatccttcgcaacaccgtctgaaacaacgataatacggtttggttgtactgacttcgtccaagccgttgcaacttgtccgtgcaacaaacgtgaatcaatacgagccaagcgaacgtcaatttggcgctcaccagagtgctttacttcattaatatcccccgcagctaccgctggtgctgcttcatctgatgaagtagcttcagtagctggtgttgcctcttccgtttcaggaattgacttcacaccttccttggcaactggtaccaagtagtgtgcaatttcggcagccgtttccattgagaaacgagcaccatatgcttctaccaacattggtaggttcaaacctgatacaatcgccatgcgatcttcgtgttgtgcttgaatacgagttgccgcgttaaacggtgacccgccccacaaatccacaaggaacaaaacttgtccctctggctcaaacgttgccaacgcatcgtcatacttcttcatcaagtcctctggaccttcgtttggcataaacgttacaacttgtacgttctcttgctccccgaagatcatttgacctgattgacggatgccggcagcgaactcgccgtgactagcaataatgaaattcaccataattgcgacgctccttaaatttattaatcccttaggtacaaaacaaattgtaccctacatatgttcatatgtaaacgctttcagggaaatacgttacaattttatgaattttcctgtaaaacgcataatatcgatattaaatatttactgtgttttatttatgaaaaaaggcttgtttttgtttagcttgtataaccagcgcgctttagcaccaatccatgttcaggcgtacgcgcatttacaacaatttcttcaactgcaaagatgtgagccagttgctcatccgtaaagatgccagatgcaatcgcgcactcacgcaatggccggttcgtcttcagcgattccttcgccaactcggctgcttgcttgtaaccaaccatgttcgccatcgctgttgcaaacgatgccgacaaatcaatgtctttggccaagcgtgcttcattgtgagtaataccagcaatcgcatgttcacggaacgttttcatggccgacgtcaaatgcgtgattgacgcaaacatacgatagaacaaaactggctcaaacgcattcaattccaattgtcctgcttcaacagccgccgtaatagtggcatcattgccaatcacttcaaaggcaacctgattcacaacttctggaataactgggttaacctttcctggcatgattgaacttcccgcctgacgcgcaggcaagttaatttcgctcaagcctgatcgtgggccagaacttagcaaacgcaaatcattactcatctttgataggttaaccgctagcgtcttcaaagcacctgataacgtcgtaaacacatccaagttttgcgtagcatcaaacaagtcgacggcttggaataattctaagccagtcacggtttccagctttggaataacgtgtacttggtagtggtatgacacattaatacctgaaccaattgctgagccacccaagttcagagtatgcaaggcagcttccgcatcttgcaaacgacgcaaatcacgacgtaatggcttcaaataggcgtggaatgaatttccaagcgtcatcggcaccgcgtcctgcagttgcgtacgtcccattttgtagacgcgggcaaattcgtcagccttcgcccctagcgtagaaatcaaagcttccaactcatcaaacagcggtgccatcaaacgaatcatggctaacttaccagctgatgggtaaacgtcatttgtactctgaccacggttaacgtgatcgtttggattaatacgggcgtaatttcccttttcatcccctaacaattccaacgccagattcgccacaacttcattcacattcatgttcatacttgtgccagcacctccttgaattggatcaagtgggaacatcgtgtagtcgattggttgctgcaaaagttgcttagtcgctgccacaatggcgtcagctgtttcaattggcaagtcgccagctgccgcattaaccaacgcggcggcttccttgatttcaatcagtccgcgaattaattccgggttaaccagttcccctgtaattggaaaattctcaacggcacgctgtgtgtgcaccccgtaatatgccgttgctggtactgaaactgttcctaaagaatcgctctcgtgtctcatcttatttagtcacctctttaataaattttgactagtgtaccgtgtatttatgcccaaagtatgtctttttgttaggcttcctaacatccagtaaccgttaaacgttttacgaaatcatgttttggcgatgatgatataatgaagggacttctttcaaggagatttaaatatgaaacaaacctttcggtggtggcaaaatctttttgtcgaatacacacttttatttgtattaaccgctggggctatttttttgccctactacttaacaggaacgtcgcttgtctggcaatcagatgggattgcacaacactttccggctttggtgcaatggcaaggcgatttgaaaaacttgctattcaatcatgaatggccgaacgcctggcaatggcaagtcggacttggcgcggattacctccaaacgtttgcttattacacgatgggtgatattttcacgtacggggttgccttagtcagcaaagcgcatgtgctggcctattacaacttaagtattgtcatccggctctttttagctggtctaagttttatcgtcacggcacgccatttcgtgcccaaacagcaaaattggcaatatctaatcggaactttcggttatatctttttcggatataccgcctttgctgcctttgaacatccgttctttttaaacccattaattattttcccattgctgattttgacgttgcatcgcgcattgcgcaaacaccgctatggctggttcactgtattagttgcgtggacgttatggaataatttttatttcgcctttatgatgtccattggtgctattgtcttttggttgggctatcaatggcttaatcagaattggttgaattggcgccaacacctagctttgttagccaatgctatcatcggtgcattattacctatgattttattctttccaagcatcatggcagtcctacagtccgctcgttctggtaagtcattagctaacggactaacggtctaccccgcctattactacttaggcttaccgggtaacttgatcggtaacttaacgacacctgacttttggttgactggtggctttagtgccctcagtgtcatggccattatttttagcattcgtcggtggcgagcatacaagccatatgctggcatttggctaatcagtttaatcggggttttactacccgttttcgctggtcttttgaatgggggttcgtccccttccaaccgttggattttcatgttggcgttaccaattagcctgatgaccatcgttatgcttggccagttaaaacaacttaccgctcgtgattatctagcattttcactagttggactcttatcaaccgcttcactgtttatcatgagtagtttcaatctgaacatgcgctttggtctagtcattgcttggttcttcggcacggtcgctgtgttgtggttcacacaacatcgcctatcacgcccaaagctcgcttggctgttagttgggctaacgttattcaacgttgtgttaattacgagtcgtaaccacactgataacaccaacccaaatcaaagtgacatgttatctactcagtcggtgaaaaagcttttggccaatcaaaaaaactacgaaccaacctcaaacaagttcgaacgtagttttgtcgataaccagcttagcaacgcaaccggtattgcgccggcaactaatctacctatcctaagccatgttaataacgttgaaagttactggtcactccaaaacggtgcagttggtaacctaatgacagcgttggaagttgccccatcaaatcccaatgatgtaacgggtaatctcgataatcgcgatgtcttaagcaacgttttgggtattaaccagcgttttcaaaaccctgacacattgacgccagcttcgtatgaagaacagtcagatatcatggtcaatggtcaaaatgttttaacgtcacagaatgcgtatccgttggtatatttaccaaaatataccattgcgcaacgtgactttaaccaactatctgcaacaaaaaaagaagctacgttagccgatagtgtcgttgtcccaagtgtgacatcaggcgaaacttcagcctttgctaaaaaggtgacaacagctaaggttcgtaccgaccaaacaaaaccggcgaagaacagcgtacatttccgttatacaacccatgcgtcattgttgcccgatggtatcttcttaccagctgataaggcacttaaggggacggaattgcatttaaccttgtcacatatcacgtaccaccctgcgtcgttaacagagcaacataaccaggctttggcacagtacgaatatgattatgagcaagcgagtcgtaacccgcaaaacgagcctgatttacgtcacaatacggctgcctactcatggaactggtaccaacataatatcaagaatgctggtaatgaaatcggtggttatacaattactgctggttatgcggatcgtgaaatgagtacaacacaaaccggtcaaacgaacctgtccttctttaacccacgtcaaagcgtcacgttgaatctggggcaggcaacaaaaactagtcaggaacaattcatcccgctaactttttcgcgacctggcacatatgagttggatgtctcaattgaggccattcctactgataagcgctttactaaggttgctaaggcaacacaagcaactgctccacatgttcatctaactgatgatgcagtcacaacaagggtgtcagtaaagacgcctcgtgtattggcaacgaccattccgtacagctcaggttggtcagccaagggttacgaccttcagaaaatcaataatggtttcattggtattcccctacacagtggtcaaaacaacattcaattaacgtacgagacaccaggtttaaccattggtcgttggctaagtttaatcggtatcgttctatttgtgctaacaacattcatacaacgttatcggaaataaaaaaagagattaacacctacgcctttaaacagcataaagtgttaatctctttttttaagcaaattttcctgactcatcagccaataacaattcacgttcaatcttttctttagcacccaaatcagccatccactcggctgggaaatctggatcagcaaacgtcatgataactgccactaaggctgcaatcgtatccgtatcatcacctagtgcagctgctgtctgaacagcttccgcaaagctcgtggtgtgtaataaggtccacagaacagcttgcaacgtatccacaacatatcccgaactaggcacctcatctcgcgtcatagccttaagacgcgagatgatatccgctgatgattgctcatcagtaatggcaagccagcctagttcttctgttccaagtgctgccgtttccatcgccgtgcggttagaacggcgaatcgccatgtctagagcacgttccacattttgtacgcgtggcatcatgcgtaggaaatagataaagaaccgtgatgccaagcgagaacgacggtggccatgcgttagtcctgtcaactcatcactaatttcttcgattgtgcgatcagaatcaaactcataaaaagcgactggccaaacacgcatcaaagcaccattaccattgttcagctcatcctctggacggaagtaacccgtatcaccagtctcttcgtatgacttaattgcggctgacgtaccattaccgacgtcaaacacttcaccatagggcgtaaatgcgccattctccaggtagtcaacaaaattccccatcaccgtctttaaatcaaagggttcaaacaaagcattaatagttgctagcgttaagctagtatcatcactccacgtaccttttggttgtgaatgcgtttgatatcccaccatttccgatgatacttcataagtatcacggtctttaaattcataagggacgccaaatgcatcacccatcgcgaaggcatacatcgcttgtcttaagtattttgctttcataagctgctcctctaattaaacacgatccattgcaaaccagtcagcaatgctcatccattcacctgtagacttggcttgaatttgatagtcagtaatatcatatagggtcttacgatcaccctttagtggtgaccaatacgtctcgtcagcacggcgaataacatcccaatagttataaacctcttcagtccctgcttcatcccggacatgaaagccatcagctaaattgaaactcttctcaccgacttgaggaccaccgacacctaaatcaacgagtaattgttgatatgattcatttgtaattggttcgttagccatatcttatccctcacttgttctatgctaagttcattttacaacagaagttgcgtgctgacagtacaaaaaaagaggcttaggcgaacctaaacctctaatgatcgggacgacaggattcgaacctgcgaccccctggtcccaaaccaggtgctctaccaagctgagctacgtcccgatattgatttgttcaaaataaaaagcccgtttccggacgtttcattttgaaatgccgtcggtgggggtcgaacccacactcccttgcgggaactggattttgagtccagcgcgtctgcctattccgccacaacggcaatttattaaacattacgtcagggcggtagatgggaatcgaacccacgcatgtcggtaccacaaaccgatgtgttaaccacttcaccactaccgccatggcaggggtagagggaatcgaacccccaccaacggttttggagaccgtcgttctaccgttaaactatacccctaaaatggagacgtaatatttaattatacggtcacaacgggattcgaacccgtgatctttcgcgtgacaggcgaacgtcctaaccaactagaccatgcgaccaatggacgttacagggatcgaacctgtgaccccctgcttgtaaggcaggtgctctcccagctgagctaaacgtccatgtgcatcgcgacgtcctatcctcgcaggaagcgatcctccaactactttcggcgctattgagcttaacttctgtgttctaactcaatttttgttgtttaacagaagttaaacgaatttactagcgaattgacttcgcaaatgtttttgcatcaagaactagcttgatgaccctacacatttgtttcatcgaaacgatattcagttttcaatgacctacgtcgtcgccttgacgacttaatctataatacagaagtcataatcaattgtcaacaactaatttcactttctgttcacatgttgttcacatgcgtcgtacctgttatttggtacttgaataatatacccctaaatggaatgttcgtcaactgctaagatttacgaatattttccgaacaatacaaaagggactcccatcactgagagtcccttgttttatatctatatatagtagtttctattagaacaaagccagttggttttcatccggcatccccgcaagcacaccgttttcatcaagataatccatcaacgtcttagaaacaccaccacgttgggcaagatcttcctttgacaagaattcacgttccgcacgcgcagcaataatacgcttggcaacgttatctcccaaacctggtacggcgttaaatggtgcaatcaacgtatcaccgtccaacaaccactgttctgaatcagacttataaagatcaaccatgctgaacttaataccacgttcaagcgcttcattagctagctctagcacggtcatcaaatccttatccttagccgatgcttcatttcccatcttacgaatctcttgaatacgtgctttggtcgtgttcaatccacgagacatcgccacgatatcaaagttgcttgcacgcacagagaagtaggctgcgtagtacaacgttgggaagtacaccttaaagtaggcgatacgcaacgccatcaagacatacgctgccgcgtgggcacgcgggaacatatacttaatcttcaaaccagattcgatataccactccggtacaccagcagcacgcatttctgcttggtactcatctgagattcccttacccttacgcaccttttccatgatttggaatgatgattcaggttgtacaccgtagttaatcaagtcggtcatgatcttgtcacgcgttccgataactgtaccgattgtggccacaccacgttgaatcaactcatcagcgttaccacgccaaacgtcagtaccgtgagacagaccagaaatctgtagcagttctgagtaattcttagggtgcgtctcttccaacataccgcgaacaaaggcggtaccaaattcaggcacacccaacgttcccgtcttagagaatatttggtcctcttcaacacccaacgactctggtgatgagaacaagctcataacacccggatcgttcatcggaattgtttgtgggtcaattcctgacatatcctgtagggcacgaatcatcgtcggatcatcgtgtcccagaatatccatcttcaagatattatcgtgaattgagtggaaatcgaagtgcgtcgtgcgccaagtagctgacaaatcatcagccgggaactgaattggtgtgaagtcatagatttccatgtcgtccggcacaatcaaaataccagccgggtgttgcccagtcgtacgcttaacaccggttgctcccatcgccaaacgttcaacttcagcaccacggaaactaatatcgtggtcacgctcataagccttcacatatccaaacgctgtcttatcggcaaccgtcgcaattgttccagcacggaatacgttattctcaccaaacagtgacttcatatagttgtgggcaaatggttggtagtcacctgagaaattcaaatcgatatcgggaaccttgtttcccttaaatcccaagaaagtctcaaacggaatattgtgcccatccccaatcaacttcgtcccatcaattgggctgagcttttccggcaaatcataaccagattcatattcacgtgggtcaacgaactcaacatagtcaccactctcactacgatagtgtggtggcaacgcgttaacttccgtaattcccgcaagcaaagcaatcaatgatgatccaacagaaccacgtgatccaaccaagtacccgtccttattagacttagccaccaaacgttgggcaactaggtaaataaccgagaacccattggaaatgattgaacgtagctcctgctcaatacgcgcctcaatgatttcaggcagcggattaccatacatacgataggccgttgcatatgacttttcacgaatttcatcgtcggctgttggcatgttaggtggatagtttccacccttaatcgcctcgacctcatcaagcatgtccgcaacaacgtgcgtattatcaatgaccaacttcttagctaggtcttcacccatccaagcgaagtcatccaacaattcttgtgtcgtacggaaatgcatatccggcaaactataacggttcaacggattagcaccaccttgggaactaatcaaaatcttacggtagatggcatcctcagggttgaggtagtgaacatccccagtcacaacaactggcttgcctaattcatccccaatcttcaccgcttgcatcatcaaatcacgcaaacgagcctcatcttggatcaattcaccttccaaagccggcacataattagctgatggctgaatttcgatgtaatcgtagtattctgccttagccttagctgcagcataccccttctgcatcaaagcttcccagaactcaccagtactatcaccagttccaagaagcaatccttcacggtacttgttcaacaaagaacgcggtacacgtggcacacgctgcaagtacttcgtgtttgattcagaaatcatcttatacaggttcttaacaccttcttgcttttgaaccaacacaaccgcgtgattagggcgaccatgcttccacgcatcgttatccatcatgtggtcattcaattggtcagcatattcaatgccatattcttcacgtgcttgttccaagaagacacggttcaaatgtccggtcgtctcagagtcaaagatggcacggtggtgttgctccagcacaataccgaagtgcttagccagcgtgttcaaacggtatgaacgcatatttggatataggaaacgggccaaaatcaacgtatcaataactgggtttgaaattgggtctaacccgtgacgggcataaccttcttgcatgaaccccatatcaaatgtgacgttgtgcccaaccagaatggcatccccatagaattcacggaactcttcgaagacctgcttctctgatttagaaccacgcaccatatcatccgtgattgacgtcaaatcaaccgtggtttgacttagtgggaacccagggtcgatgaactcagagaattcggcaaccacgtttcccttaaccatgcggacggctgacaattcaatgacccgatcataggcagctgaaagaccagtcgtctcgacgtcgaatactacaaattcggcttcatcaagcttcgtgtgatttgggtggaaaatgattggctcaccatcttcaaccaagttaacttcaacaccataaatcatcttgatgtcattcttagctgcagaggatgctgcttctgggaatccttgggcaccagctgtatcagtcacagcaatggcgtccatgccccacttggcagcttgcttcacgtagtcaccaatcccgttagtggcatccattgtcgacataacggagtgcgtgtgcaattcaatgcgcttcttctccccttcataaggatcgatgcgtggcgcatgcttaataacctcgatgtcgtaggccgtcatcgtcaagtcacgcacaaaatcatcttgttggattggaccgcgggcacgaatccacgtacctggcttcaagtcagcaaagaaggcttcgtcattttcatcacgtgagaacttcttcaagataaatgaactcgtgtaatcagtcaccttcatcgtcaacagttgacgttcagacttcaaaacacgcacttcagcgtcaaagacatatccttcaacgataacagaacgttcttcagtctcgatgtccgccatcttagtgatttctgcatcagaagcaatcttgcgaccaagggtacctggcgcaccgctaccaccaccattacgtggtgcagattgacgttgcttagctgcttgttcaatttgcaccttggccatttcggctagttgttggtcttgagcagcacgttgcgccatgacttgtgcgtgtgattcagcggccaattgttcatcaacttgaatgttaaatggtaattgatagccaaccccaagcttcttatatgtgccttcaataattggcaaaccagtttgacgagcataattcgcccaaactgctgtatcgaacgtcaaacgcaattggttgtcagcgatttgtggcaacacatgggcaaacgcctgacggaaagcacccggttcattttgatgttgctgcaacacccacgtccaataatcaacgatttgttgggcatctggttgtgtcgtcaaatgcaattggtaagtggtctgcgcaatgttagcaaaagccgtttgcatacgtgccaccaaagcggccatatcttgcaccggtggtagagcgggcatttccaagtggaactgccagactttagactgtttgtgcacggctagcttggtcaacgcagtttgttgcaaactagcagggacttcctcgtattgcaattgctgcaatagcgtttggaattgttcttgtgcggtcaacgccatgttaggtgctcccttctctcatttttcaatatgcgtttaattataccttgttctagttacaacaacgtatcgaattaacatacaaacaaaaaacgccatccaacttaatggatagcgtttagcggatcaagccgaacgggcaattcggcgatctattcttatgacatgtctcagcacatcataaatttttaaggagtaggtttcaggttggttagacctgtaggttatgagtagtatttatgggttgtcgaatgaatatccctgtatcccttatcgacatccttaatattacgcacgcaaacttaaaccaacaataaacacctattaaaaatgcgtaaatgccaatacagttagcacagcaatgacggcccacaagaacttgcgcatacggtcgccctccttcacttatctttgatacttactagtatcgcatgcaaatgtgtccattttatgaaagcgttaccaacctcgatcaataaaaaagctacccagccctagccgagtagctttctagttatctgtcattaagcttgcgcatcaacttcagggtgcaacaagatttgtagcgttgcaaccaattcttcagcacgtacttcgatggcttcgtcagccttacgcaacttaacttcaacgataccttcaccggccttcttaccaaccgtgacacggactggcaaaccaatcaagtctgaatcgttaaacttaacaccggcacgttcgtttcgatcatcaaccaaaacttcgtaacctgctgcaaccaacgtgtcgttcaaatcgtcagtcaatgccttttgcgtttcatctgagtacttcattggtaccaagtgaacatcccatggtgcaactgatgttggccatgccaaaccattttcgtcagcgttttgctcagcaattgctgccaacaaacgtgacacaccaataccgtatgaacccatgatgacatcagcttgacgaccgttagcgtccaaaacttgtgcgcccatcgtctttgagtagcgtgtacccaacttgaagatgtgaccaatttcgatacccttagtaaattgcaagtgacccttaccgtcaattgccaaatcaccttcacgagccgtacgaacgtcagccacttcatcgatgcggaagtcgcgatcaacgttggcgttcaagtagtggaagccagcttcgttaccaccaaccgtaatgttaaccatgtcagttacccattcgtcggcgataatcttaacgtcttcaccaacaccaactggtcccaatgaaccaaatggtgcacccaagatttcttgcgcttcttcttcagttgccatacgcaactcgtcagcgtgcaagaagttttgtaccttaacttcgttcacttcaaagtcaccacgaaccaaaaccaaaacaggttggtcatcagcgtacatgaacaacgtcttaaccaattggtcaggtgtcgtttgcaagtattctgccaattcttcaatcgtcttaacttcaggcgtggcaatcttttccaagtcagccatttgtgcgtgtgacttgttaggtgtgtacaaatccttcgccatttccaagttagctgcgtaatctgactcatctgagtaagcgatgatatcttcaccagcttcagcaggagctgagaactcctttgagtctgaaccacccatggcacccgcgtcaccaacaattacacggtagtccaaaccgatacgatcaaaaatgttgatgtaggctgattccatgttcttgtatgactcatccaaaccttcttggtccactgagaatgagtaggcatccttcataatgaattcgcgaccacgcaaaacaccaaagcgtggtcggttttcatcacggaacttcgtttggatttggtaaaccgtcaatggcaaacgcttgtatgacttaatgtcatcgcgaatcaacgtcgtcatcgtctcttcgtgagtaggtcccaaaatcatgtcgcggtcgtgacggttcttcaacttaaacaagttcggaccgtacgtgtcataacgacctgactcttgccacatttctgctggcaaaagcatcggtgctgacatttcaatcgcgtcaatcttctccatctcttcacgaataatcgtgttgatcttgttcaaaacgcgttgtgccaatggcaagtatgcgtaaacaccggctgaaaccggacgcatgtaaccagcacgcaacatcatttggtgcgagataacttcagcatcggctggcgtttcacgcaaagttggaataaaaacctttgattgtttcatggaaaacttccctcgtccctaatcttgacgacataacgtcactaaaaattcttttactagtttaccacagttacccaagaactaccctacccattcgcacaaagtatagaaaaagggatgccaaattggcatcccttactcacttacttaaaaaaataacgcaaaatatcgtttccggtaactgccaccattaggagcaccaagaacaacacaccagccaacgtaactgtcgtttcaatcttctccggcaccggacggcgaataaccgcctcaaccgcgttcaatagcaacttaccaccatccaaaccaggaattggtagcaagttcatcattcccaagttaactgacaaccatgccgcaaatgacacaatcgccaagaaaccatatgaactaacctgctcggtattcttgtagatggcaactgggccgcccaacttattcagtgagaacccttgaaccaaattctggattgcacggaagatttgcgtcatcgcttgtcccgtggcacggaacgcatacgccacacgcggaccagccgctttggttgtggttggtgtcacgccgatttgaccaatcgtcataccaccattcttaaccgacttaggcgtcacctttgtggtcaattgcttaccatcacgttcatacaccacggtcgtcttcttacctggcaaagcttgaatcgtatcttgcatcttttgccaagatgtcattttaacgccggcaattttttcaatcgtgtcacccttcttcaaaccagcacttgctgctggtgaatcttgtgcgattgactgcaatgtcgtcgttgttacacctggcatcgcaaacgccaaaccaaggaacaataccaacgtcaaaatgaagttgttcatcggaccggcgaagttaatcaaggcacgttgccacaacttagccgattcaatgtgcgtatcacgtggcgcaactaggacttcagtgccgtcagcttcaatcaccgacgcatcgtgatcaacagccaacttaaccagcgttgactcatccccatcccagtaaccttcaataaacatgtcatcaactaagtcaatgcggttaaccgttaaggcgcgaccacctactaactcagtttgctctgacaaattcaaacgggttacaacgccatctgtctcaacgacaacgactgtcatacctgggcgaatactttcttcttcagcttctgcacgtccagccatacgcacgtaaccaccaacaggtaagatacgaattgtataggttgtaccgttgcgtcgtgtctgtagcaacttgggccccatcccaattgcaaactcacggacacgaacaccggacttctttgcaaaataaaaatgtccaaattcgtgcacgaccaccaacaggccgaacaccaaaataaacgtaataattgttgtcatcagttaaactctccacgtgttcccattatgctaggccttagtatacaacaaaagcctgaaggaaactttaatttcccccaggcttacgaatcttttagtttagtggaacaaaccaatcaagtacatcaatggcaaaacaatcaacattgagtcgaaacgatccaagataccaccgtgaccaggcaacacgtttcctgagtccttaaccttgtagaaacgcttcaaaccagattcaatcaaatcaccaaattgaccggctacagaaagcacgatgctgatgataatcatgactggccagctgtacgcttgtgggaagaagtacgtgtaaactgccgctgcgataaccgcaaccaccgttccaccgattgaaccttcccaagtcttgtttggtgaaatcttcgttagcttgtgcttaccaagcttgcgaccaatcatgtaggcccctgaatcagtcaaccaaacaatcaaaaaggcaaacattagtgtatctagcccagcgttacgggcagccaccatcatgccaaatcccataccaacatacatcatcgtcaatgtgaatacaccagcatcttcgaagctaaacttgttcttagcaattaccgtgtgcaacaacatcaagataacaaagatgtacaacaatgatgagcggtgcaagacaaccggtgcttggatggcatcccacaaaccaactggtaacgtcattaccaaggcaccaaccatcgtcaaaattgctccaaaatcaactaacaacgtcttgcgcatcaagacgacttcggcagccgcaatcactgcgagtactgatgctgccacttgaatccaaataccgcccacgtacaagattggcaagaaaatcgccaatgcgacaatggccgtaatgacacgtgtcttcatagtcctaaacttcctctattttttatcacttttattttctgcaatcccaccaaaacgacgatctcgtgcttggtaatttgcaatggccccttcgaaaacagattgtgtcatctcaggccagtgttcgtcgacaaagacgaattcagcatatgccaattgccacaacaagaaattagacaaacgcatttcaccactagtacgaatcaacaaatctgggtctgcgtattcgccaagtggtgctgtcatcattgcgttgctaatcgtcgcttcatcaatctcttctggcttaagttcaccagccgcgacttgttgggccaacgtttgcacgcccgtcacgatttctgcacgaccaccataattcaaggcaaagttcaaaaccatccctgtattattagcagtttgcgcaatcgcatcattaacggcacgttgcgtatcggcgggtagttgatcgacataccccatcacgttgacacggacgttgtttgcaatcaactcaggtacgaaggtatcaaaaaactttccaggcaatttcatcaagaacccgacttcagtctcaggacgcttccagttttcagttgaaaatgcgtacagtgtcagtaccttaacgcccaaatcactggccgtcttggtaatgtccttaaccacttccataccacgttggtgaccggcaacacgaggcaagttttgtcgcttagcccagcgtccgtttccatccataataatcgcaatatggttaggaatacgcgtcttatctaattgtgtcgttgtttctgaatcgatgactcgtcgctttttgaaaaacacaacgtttcctccgcctctataaatctaaaatgcgcaaccaatagttagttacgcatgtcaatcctatccattatagcagtttattagaccgcgtataggcttttagtacaacgataacgcttacttagtaaaaactgactcatcatcgtcatcaaacgcaccgcccaacaaggcttcgattgtgtccaaaaccccgttgtggttattatcgtttacggccaaattattaatacgaaccttcataaagtcctcagcgtttggcataacgaatggatacttcacatagcgaagcatctccaaatcattaccattgtcaccaaaggctgccatctcttcaggcttgatatcccacttggccgctagttgctcaaggccagtacgcttgtttacgcctggtgccaagatatcaactgatccaaaccctgaacctgtggtgtgtagctcttcgccaaagacatcacgcaattgttgcacgtgatgatgtacatcaacatcttggtcccaaacaagtgagaatcggaaaatactatcttccacatccataaacttctcaacttggtgaaccgttggatagaatgtcttcacagctgcaatcatttcaggggtggcgtggtttgagacgtacgccccatttgtacctgacaaaataatcaaattatccatgtgtgcatgtgtctcagcattccattgcaacacacgagaaatttggtctggtgacaatgctgattcagccaataccgtattctcgtgggtaatcaacgcaccgttatctgacacatacgtaatgcggtcagggttaaccggctcaaaataagaacgcaattgcttatattggttcccacttgctgcgacaaagcggatgccacgttcgtccatttgatctaacaatgcctccattcgtgcatagtcaaatgtgcgatcatcacgtagcaatgtaccgtccatatcggttgcaattaacttaatcgtcattgttctgcttccctttcacaattaattcactcttttacctaaaagtcattataacaaactgtccgagactgcgccgaatttgctacaattataaggttagtttagttaattacatttatatgaaaaatatcatgataaaggaggccgttcatgaatgacgattatcaagccagtttaaatcgacttaaccaattggatggaccccaagcgactgtctcatcagcagagccgcttcaccgcggaccacaacggcgaccacagcgtgttgataaccgaccacaatggcaacaaatccaatggttttcaattctattcgctgtcgtctcacaattggcaatttggtgggtttatccgctcatttattcaaaaaatttaacgagtggtcaatggcaacacaatcccctcttaatgacctatagcctaattttggcattagcaattttcctaactttcaaccgtggtttctcacgctggctgaattttgcggtcatcttgattccgattgtgttcttgtacttcctatacaagcaagtcacgactcaacagattattttgttaggattacttccccttgcgctattgctcattaacgttaagtggttaaacctgcaaaacatcctgggcttaattatgtattctggggttgcaacactcgcaatgccggttgtcatcttctatcaacaaaatacattcttaacattgccctttattctaagtttgttgccgttgctattcagttacttgtactacatgagtagtattttcgtaccaaccggtcgtaataagcgtgctacatctttggcatttggtatcattcttttgttggatgtcttaaccttgccatggaacttatggacactattggcgattgtcatcatcgtcttcacgtggatggttttgattaacctcgacttgaagccaaaatatcgcatggggatcttctccttgctacaagcggtcacggttctagtgattttcttacaacaaaaatagcaaaacgccctcgcacgaaattagtgcgagggcgttttttagatttctgttgtaactgggcggcgcttaacgcgataaacaaagacagctgatgcattaccaatgactaacatcattagcaaaaagacaattgggtggttcttagccatgcgaactggccaaacaccttcttccgtacggccagcgttcacatcacgggcccaacggcggttctctaagtctggcgtatcaactgctccgacaatcacgggctctgattttgcattttccgaaactgaaatatccgttacctgcgttggcttcatttcaccatctggtgattcaataatcggctcgttatagtcggattctgtgtgcccactgaacttgtccttaacaccttgaatcatctcatcaaacttttcaatcaaagatgattgtgcaaccaccgggcggacagcatctgcgtttgctgctccttgtgtcgctagattcattgccatgaaggtgacaaaacataaaattgctgatcgttttttcattgtttaactcctctaaaaagaaagtgccctttctccgtccaataccctgaaaaaacttttcatgagccaccacaattcacaatgttgttccaagttatttacagtctaccttatataatcttctaattttaggcgattgtttgaataagtcgtgtccttgaaatcgcattcattgttttaattgtgtcctttttccgggttttctgtgtgctatccacaattttggacgttgttgaaatacaaagtcccacggattgacaaattttgcaccaaaaaagacccgtaaaaatttttacaggtctttagtcattaagccttaaattgtaacttggcatcagcaactgcataccaatccttcacacgatcagcaacttgaccctcagggaagtaagttgggtaccagtagtcgataaagttcaactcatcaacgtgagtttgctcatcattgcgccaagcgtcacgtacggtcgtgtcaccagtctctaggttcaccttgaaacgaacgacgaactgttgcccatcaatgtggacatataattgacgtagaccagcttcgcctgggaatggttctgatgtaatttccgcattcgtctcagacaacacatcaacggcatgttgtcccatgtaaccattatctgccatcatacgcaaaaccatggcaaccgtataatcacgcatggtgcgttccttgaaatatgccttgtagtcaaacatttgttattgccccctaaaacgttgctgctagcaactttacctgttccaaaatacttagtaactcttggtgtgcctcatcataagcagccatttgatccccaaattgctcattgaagccctccaaaccacctgcgataaacgcgtattcaaatgctgtcaccttttcaaaggcatccgtaaaggtttgccagatatcgtcatcgctttcttgcgtttccaagaagacttgaatgaaacgggcatccgaataccccatttcgaattgcaccgctagttggcgcttgaactcgtgttgattcttaatatgcaagaagtggtgttctgtgttccaagttacacgttctactgcttttaatactgtttgattcatcactaataagcctcgtttcttttcaacacctaaatggtaacactttgatttcctgcgggcacaaaaaaggcactcgaatttcgagtgccaattctgattataattcggccaacgttgctgaatgacgttccccattaaagtagaaatctaatccttcagcaaatggcaccttgttgtctgcgactgcttcaaataatgtccatgatgcttgcaacttgcgcgcatcaacatccccgaagacatcaacaatgttagcagccttcaagtccaaaacaatctttgtcacatggagcaagcgctcagctagcgtttcattcgccaaataagcacgcgcctcttccgcatctgctagaccataataaaccgcacgttcgcttgaacctagtgaacgtaatcgtgggaatacccaccacatccagtgtgaatccttcttgccagccgtcaattcgtcaaccgccgtttgaaagctgtttgcgttttcttgtgccaaaacaaatcgttgcacatcatttgccaatgcttcatccatgacctatcacctcattcatattgataagttaattctagcatgatgtgttgttttcaccttggttcaacgttcagtttggaacgtctcgatatgcgttaactgatttgtcgaaacatcatctgcttttggtgacagcatcgcactcataatattatggccatctgtcgtatgccctaatccaagcgcgtggccgagctcatgcgccagcgttttcgttagggtattttgattcgacaatgacaatacatcgccagaaacccgtagttcaccagttgatggattcatccaagccaatgcatgcgtaccagcatcggtgccttcatcacccatcgcacctgctcgcacaagcacatctggactttgacgttgttgcacttccttgatattaattttgccatgggacttcacccgccaaaacttaatggcccccttgagtgcgcgctggacattcggcgtcgttgtttgaaaatccgattgcacaattgcgacggttaactcaccatttttaccggtgtacatccccagtgaatcacttgtgggtccaaaaccaccatttcggagtaatttttcattgccagtctcagcttgtttaattgtcaaattattcaactgtcgacgctgcgagctatagttaatcgcactcataattggctcgaagctactcccgaccgacccgaacaccaacaataaaatgatgctggtgtaaataattttgcgccggtgccgcggtttgcgaggggccggctttggttcatctgattctggctcaacaatgccataagtatcataaattagttgatccagctctttatctttttcatccaaattcgccaccccctttgccccctatcatactgggtcaatttgaatttttacagaaaaaaagagctggaaaaccagctcaacatcattgattcaatttcggttgtacattgtttgctgcgcgatagcaatttgctctgataacgcttgtgaatccacttgcgtcaggacgtgataatccactttaatttccttaaacaacgcaaccaatgtgttttgcgcctgttccaactgttcatcagcaaattgtgacaccgccgtctgcttttgcaccgtcatatacatacggataattttcaacgcattcggcacgtggttataaagaaactcatcagccagtaccaaacgttccggcttctcagccaaggttgccattatgttatctgtgaatagttcgaactggtatcgatcagcgattgcttggagttgcgcatcggctttaaccaggtcattaataatttggatatcgttataacccgtggcaaacgctgtctggaaggcttgcttatccttacgcgataacccagtcaggtcataagtatacttggtgggcaaggttgcgctctgcacaaccggcttatcttgtaacaagccaaaccgtgctagcaaaacaacgaccgcaaaaatacctttcatttgccaggttggctgcgttaaaaacaaaacaccgactaataaagtcgccggcatcaaccatagcactgccaccttatcattcggcaaaattcccgccatgacagcaccaactaaaatgacaacgctagctcgcggtgcaacggtcgttaactccaaaccaagcgcacccatcaaaaaaacggcaatcagtttattgcgacgcaattcaaccgccgttagcgttctaagatttaacaacatcagcttccctcgttttctacgtcagtcactagtcgtcccttttaaactaggtgtatactgtttaaaaaacaggagccgaatgatgactaaattaacccgtcaaatcttaatactcgtgattttcagcggattattacttggcttctatgttatcgctatttatggaccaaaagcaaccagatataccagccctagtttcagtgaaccgtcggcaccattgacctcatcgtcatctaactcaagttcatcagcaatcgattactcacgggcaccagccaacaaccaccaagactatcaatcaacgttcttggataaagacttgcatacgatgtctgtcacggctaacaacttgaaattcaccgtgtcacatatcaacattttggataccaccaacgttgaatcgctcttttcgccagctgaaaaggcgtttgttaaagctgatgtgtcattaccctacgagttttatcgcgtcacacttgatgtcacaatcactaattagggcacccagcccattaaccttttgaacaccaatgtcgctgggtggactttaattgatggcaacgggcaatcctttacgcattctgatatgcgagttggtcattacatgtatgatcaattcaacaccggtattcttgaacccggtgattcaaagtccggtgactttattgtgctaaccgattcaaatgatttcaactatcaaaagttgcaatttatcgctgccggtatcacgccggacaaaggtactaatatcacacctgctgctttctacctttcaactaccgaataacacaaaacgcgcttatcacaacattgtgataagcgcgttttttcatgcaatttagtatggcatcttaatcgcatccaagagttgcatatcagctggactgatttcaaaatcaacatccgcattctgagtaacatactccgggtggttagcctttggtagtggcaacgtgcccttggccaatgcataacggatggctaattgggccactgagcgatcgtagtgggcagcaatttcttgcaactctggcatgcgcgacaaacgtcccgtgccaattgggctgtacgcctcaactagcaaaccatttgcttcatcgaatggttggttcacatcttgcgtcatcccaatgtgataaataatttggttaaccgcaggtgtaatcgacccgttgtccaaaatatttttcacatcttcattattgaagttcgacacaccgatactcttcaccttaccagcttgtaccgctttttccatggcttgccaaaccgccaagttttcctcgtagtagttattaccacgacttggacgtacgtttggcacttccatttgattccaaggacgtggcgcgtgaatcaacaacaagtcaatgtagtccatgttcaacgctgccaatgactcatcaatcgaggtagccgcgtgacggtaatccttaatgctggcgtcaatcttcgttgaaatcgtcaatgtgtcgcgatcgatgccagattctgcaatcgcagcccccaccgcatcttcgttttgatacatctgcgccgtatcaacatacaagtagccagccgccaaagcagccgcaactgaatcatgagcttgttgcttagtttgttgccaagttcccaagccaatctttggcatcaacatgccgttatttagtgtgtatgtttcgtgtaaaaatgacatcgttctgacctcttttcaacttcatacgcaatatgatacgaccacttcgccaaggtgtttagaaaaagggtattagttttcagctaacatctttttaaccgccgccaccgtcgtttcagtcgtcaccttttgttcaaccttggctagttccgctggcgtggccattggattcgcttctcgataagccatgacttgttcagccaccacctgctgcaacgcttgttgttgtgctgtatcttgggcgccttgcaactttgttagttgctttgcctgtttgtcagttactgctaaccagctcgactttggcatcgtgaccactgaactttgcttggcaactgtaccaccctcaccaccaaaaccaaggaggaattcaaagaccttgtttcgccattcccagcgcgtcgttgttgtcgtaacggtcgcttgtgaaacattggcttctcggtatgttgcactctttttgactgcttggaccatatgtttggtgtcaggtacaaaatgcggggtggctttagcatctttcttatcagcatagaccagcacatagttatctgccttagtccccaactctttggtcactaatacgccaattggtagcttatcaccaaccgctgaataaatctgatgcgtctcagtcttggttaccttttccataccgtaatgacgatcaaagttaacgagcaataacatcaccaatgccacgaaaactgtcccgctaatcaaccctaatggcacacgccaagctaacggttcaatacgaatccacgctagatatgtcaaaatggcaaccactgctaaaatcggaataatcatgctgcatcctcctcatttgttgctgccactggcacaatcttaccgcccttcaagaagagcgcgacgataataccgataatcgcgaaactcaagccgattgcaaacgacacatgtaaccccttcatcgacgcttccaaataatcagccccatattgcaatgggttggtcgtcgccaaatgcttggtcggttcgtgatgcgcaataacgttttgtgttaccgacgacagtaaggccaccacaattgctgacgccacttgacgagcagtattattagctgccgttgcgtgcggtgcttcatttttcggcaacaccgccatggccatcgccgtcaatggcaccaatgccgtcgcaattccaaacatacgtaccgcataaagtgtcgtgatgaaatgcgtcggtgtcgttggtgacaagaataggaatggtaacgtcctgattgcaacgaacgtaaagccggtaatcgtcaagcgcttagccccaatccgatcataatcacgtcctgccaacaccgccataataccaatcatcagtgcacccggcatcaacgttaagccggattgcaacggtgttagcaagtgcacgttctgcaagtacgttgggagcatcatttcaacacccatcatggcactcatcgacatcatcacacagatggtcgtcaacgtgaattgccggttcttaaacacacgcacgtccacaaacggctcatccaaacgcaactgtcgtagcacgaatagcacaataattaaggcacctataatcattggtgcgataaccgtctttacattgccccagccgtcggttgcaacattggtaaacgcccacaagaacgaaccaaatcccaccgttgaaataaccagtgatggtaaatcaagtttcatgcgttcattcttaatgacgtttttaatacagaatggcgccgcaatgatgaccagtgccagcacggccatcggcaagtggaatattaagcgccatgagccgtttaagttcaagcccatcaccgtgccgtgtttttggagcaaccagccggacaacgtcggtccaatcgccggtgccaatccgataacgataccgttcaatcccatggccgtaccacgcgattcagccgggaagatattcaccatgacgacttgcattaacggcattgaaataccgacggcaattgcggcaatgattcgaccagccaggaacatccaccacatatcgtgctgggctggtgtcagtgacgcaatcgtcataccgatgaatagcagtaaatacgctgtgatgtacaacaccttcgttggtatgcgagttgataagaacgctgacactggcatcataatgccgttcgccaacataaaccaggtggttgcctgctgtgcagttgccaacgtaatatcaaaatctcgcattagcgttggaatggcggtcccgagcgatgtctgcatcaaggctccggcaaacgttccaatcaacagcaccgcaaccattgcattacggttgaacggtttaccattgatgtctgtaaactgttttttgaccatagttaccccctcaataactttatttaccctatcttacggagcgaatttgaatattgtggggatgaagccctgcctttcatgcaaaaaacactgaacagttgacccgctcagtgttttcagaatatttatacttgtgatgctggataaacaatccaggcgtaatgttgcgttgtgtcaaatagcgccggcaacgtgtatttctcgttttgaatgaaagccgtggtgtcaccatacggtccaccagttcccaaccacatgcggaacgtagcgtcgtcccgattaactttctgaccaggcaaataaatcgtaatggcatcatttagaccaatgccgtatggttcggctgtgacttcacgcacaccatcaacaatcgtcgtcgcatttgctggatcataatcgagttgtgacactgtcattgtgtaagccgtatcggacaccttttggacattatctaaacggcctgtgaattctgaaattttcatgcttcccttgggataatccgcccctacgtcacccatatctgaatccgaaaacttaccagaaaatgtaccatcttcattaatggtcatgaccgtgcgccagccacccgctccagacgtgaaccaaaagtcgcgaccagcaatttgttgaaaaatcgttttctgttgcttaggtttctcagcctcattctcactggctgattgttgcttggcgttcactgtgaccttgtttgttgaatggtcatcgctaatcatccccatccccacatagccaaccccaaccgctacagcaacacctatagcaccaattccccactgtactaattttttcatgtgcccctccactagaattgcatggcgttctatgaattcagcataccagaattgatcagattggctcgttcaaaagctcaatcggtaataaataaaaaaggattccgtcccacagaatccttttcaataaatttaaatgttaaccaacttgccctttttgtccttagcaatcataaagaatacaactgccgcaatcgaccatgcccacacaatgtggccgaagaattctgagaagtgctcatcaaatggttggttccaaggagctggcacagttcccattgctggcatcaaaacgatgtgccaagcgaaccataggaagataccgtaagcagcaccttgccacaacccaacctttgaccagtattgtgaaataaatacataggccatggcaaagaatacagaaaatgagaagtgcaaaatcaatgtaaaccaaaagaccttttgatcatgtgaataatatacgtatgcgtgtgtcaaactgtgtggcacaccaaactgttccatcattgtttgtggtggattcgtcaaattacgcgcaattgtacgcggtggcaacaaattctcccaaccaatcttaaccatgccggaaatcattccagcaacaaagccataccacacactcttaaggataatttccttcaagctagcgaccggcttatccaacttaaacatctctatacctccataagtcgtcttacgcacatttcctatacgcataccaactaattaacattgataaatttatcacaaggcacttacaatgtcaaagcaatttaaaaaataccgtttagcatagcagccaaacggtatttcgtattatttttcttcaattgttttcgtgaccaggtcacgcgcctgcttaatggctggctctgataagcaatattgttgcatagtggcatcgataatcgcttcatcataaccagaattagcggccactaacttcactaactttgcgactcccactggaatatcaatctcacgttggtataacaaaccatggtacatcacttcagtaaaaccaccccacgcatcgatcaaattaatgtccagcttcgccggctcaacaaccttgtgcgcagataacaactctaacgaccaattgatttgttggaacatggcagcatcagctaaccgacgattttcaagaatatctaaattgaattgacgcatctcttttgaatggaaaaacgtgtaaaaataaatctgaatggctaggtaataacgtgacaatttatcaacgtcaggatacagttcatcaaccgctgccatgatcgtttctgatacttgtgcgttaacaattgtggcaaaatcttccttctttgagaagtaatactgcacaattgatcgttgcagtcccgcgcgttgggcaactgccgaaaaacttgttttggcaaatccctgctcaacaaacaatccccaaatcgcacggcggatatcggcaattgtttgctcattacgttgtcgtcccatgtaaccccagcctcctaaaaagaacttcattcattttcgcccatattcaacagaataacaagcaactgctgtattaaaaaataccgatggcttaacaaccatcggtatttaactttattcaattaattaagcgtagttcttcaagtaagaaatacccattgcacctggaccagcgtgcgttgattcaattggcgttgtttccgcaatatccacaaccgcgtctgggaacaattcacgggcacgcgctgccaagttttcggcatcttcggctgcatcggcgtgtgaaataccgataacagcaataccgttttcttctgcttgcatgcgctcaaaaatcaagtcttggtaggccttgattgtcttcttaccacgacccttaacttccatcgtgatttggccaagcggcacgtgcgcaccaaccttgatatccaacaatgaaccaatcaagccagccgtctttgacaaacgaccacctgcgactaggttcttcaatgtgctaacagttaggtatagttccgtgttatcttcaacgcgttgcaattctgccaaaatttcatcacgcgttgcaccggctgcagccatgcgaccagccaccaaaacttgcatggccaaggcacgatcgatgtagtttgaatcacggacaaccacatcatgcggcaccatgcgtgatgcttgttcagccgcttgcaccgttcctgacaacttgttcgtcaaatgcaatgacaagatttcaacatcttctggcatggtttcataaacttccgtaaacgcacccaatgatggttgtgatgtcgttggcaatgccttagcttccgccatcttttcaataaattcgcttggtgtaattgataccccatcgtggtaaaccacaccatcaatcatcaccgttagaggcacaaccgcaatatcatatgcagccacttcttccggcgtcaaacgcgctgttgagtcagttacaatttttactttagccatttcaaattccccctcgaccttctggttaaaatacttatgtttaataactaaaccatctagtatctaaaactatatcatatataggacgattttaaaacataggtcagtgtttcaatagcgcaaaaaaatactcccaactagcatggcgctaattaggagtttcattgtcatttaaatcggcgtttcaagcgtcattcgctcagcgatatctaacaagtattgtgacacttgctggtcttgcattgttttaatgagtcggacaaattcatcgaaacgtggcttagttaattctgctaaagcacgtgagttatcaaggaaggcgatgatgatttgtaacccgaaataagcttggcgcattgttaacacgccaaacaattcactgcttaacaacttcgtgaattcctcgtcggatagtttttgtagtggcatttgccattggccgccagccgtttctgtgagattatcaaggatttcttcagctaaacgaacttgatcagcttctaatacatcccccaattgaatctgtagtttctcaataaagatgtcgacttggttatgatttgactcgcgcaactcagccggtgttgtcgccatcaatactggtagctttaccaattcagttggatgtaattcctcctgaactgctcgcaataaacgttctttatcatcaaagactacttggttacggtcattcaattgtaaaactggacccagcaaatcattaatttgttgcaaccaaatctgaacctggtgctggacttcatccgatgactggtggccaaacgccatcgcgatatgcttgatcatctgcaccttcgttcggccgtatagtgcatctaacactgccaactgtgtattgtgggcgattgttttttgccaacgttcaaagtcataatcagcttcccaatccggatccaaactttgaatgtagaacggttccatgtattggtaaaacaagcgcgcatcttggttcttcaacttgatatcttggaacaaacgttcattttccaagtaatcccatagaccaccaaatcctcggccaattgcgccaaacttctcttgtcccgccttgctagcccaataatcatctgcgaattcatccaatgcctgttggtcatttaaactgatgccagcttcagttgcgaccgtcgccacccgcttatctgctgaataatagcctgggtatgacgcctcatgttcaaactgccaagccaattgttgggcagtcgtcataaaggtcggcgcatcaactgccatggccggattagcatccacaaacatcgcaatcacatcaggtaagtgttgttgttgctcaaccgtcaaaactaccgttggtacaaaataattgaataggatacgcttcaggccagtcgtcgtccacttacccaatggttcatgtgcaatttcacgcatcatatcagcaaacaacggcagcatggtcgtcaccattgactcttgtatcgtaccgtccaatgtttcaaattgtggctggcttgccaacttagtcaacaacggcttaatactgtccgtcgtttgtgatgtttcatcggccagcgtctgattcgctaagttatctcgataagctgctaattcatcaatcacccattgttcagcaagactcggcgccaaatcaacttgtgccatgccattcagtgccaagaattggagcaaatctgtcgtgaatgcaattatcgtttcatcatccaacgcttgaaattggtcatgcgacccaatcgtaaaggtcaatcccaacaacacatcttcgacatcccatgcaatcgttggcttgttagttaccaaatacacatcatccaaaatcgctgcgctcatttgttgggcattcacccactccgtttgcttggcgaatgatgccgttaagtctctaaattgttggcgattacgcttcaacgtccgcttgttgattggtcccaacgccgttccggccgttgataaaccagcccgtacgtcatccacaagcacttcatcaataaaaccatcttgatctaatttgagttgcatgattttatccctctcaactactttaattaagagtagtatacagcaaacgctcccggctaacagttagctagtcaggagcgttcatttttattatcgcgtgaaaacaatcttgccgtgcaaaccgcctcgcttaatccggtcataagcagttttaacgtttgacgcattcaatggcaatgtctggtcaatgattgttcgcaatgacccatcagccaatcccgcaaataaatgtgccagattttcaccagctggcttgttaatcaagctgataaagcgtggatcatctgcttggtgcgcaacaattgagactagcttaccggttggtgtcagaattttagcagagtcggctaatactttttccgagccaaccgtgtctaatgcggcatcaaaatcatgaagcacagttgtaaaatcgtcttgcttatagtcaaacacttgtacctttgggaactgttgacgtaacatatcagcgccccagccagatgctgtcgtcgcaacttcggctccctttgcccaagccagttgtaaggccacataaccaaccgcaccagaaccgccgttaatcaatactttttgtcctgcttgcaagttgaagccacgctcgattacttgataagccgtttgtccgccaagtacaactgataccgcttcttcgtatgaaacagttgctggaataatagccgctaaatgaactggaaccgcaacttgttcggcatagttcgcgccgccgcgaacttgcgccgccactcggtcaccaacagtaacggacgtcacgtcttcgccaaccgcgatgacttcaccagcaaccgttgatccgagaatcattggcacttggccacctaacataccttctgcaattttatagtcaactggatctaccgcctgagcctgcgcttgaacgagcacttcgtcacgtccaattaccggcgttggcacttcttcatctgttaatgagtccaaatcattaaaacgatgcaaaacaacagctttcatgatgatgcctccaatgttttattacgttagttataccacggtcgcacacaaaacgcccagactagtcttgtaccagtctgggcgttttgctgtgttttgtttacttaacaagtgtcgtttctacaaagcttgcaaggtagtctaggctgctcaattgtgcattgcaaagtgagctatcacggcaaataagattaccgcgcttcgtataattaccttcagcacctcgtgacttcacctttgataggaacattgaaaccgttcctagttggtgacagatggcgcacaatccgttcaacggctttggatcgaaatcaccatagatgcccaccaacttaccgtcacgtggtgcgacgatgtacttcttttggctaccattgtcattccatcctaagtaggtcatttcatgacgattcatgttttcccacttaggttcaggtagcttcttaaccttcttgaataacttgccaagttgatttgcactcaactcagggaacggcgtcaccaattcggcaagttgcttaaatgcatgttcagcacgttgctttgacagtgcaatttcaggcaattgcgccaagaactcattggcgacatccgtgtctggcaaaatggccttaactgtttcaataacatcggcctgaacgacagacttaacgttcttatcgttaactgagttaaacgccttgttcaagatgatgacttgttctttgattgcaacgaattcgtgcggttgtaattgtttgtccatgtttacgctccatttcaagatacacatcgcacagactacgccggcgatgacaattaatttgaattaaccttcatgtggcgtacagacaatgacccaaatactggcatcttcatcaactccattcgttttccatagttcaatcattatatagaaatgtgtaaaagtaagcaataaaacgacctgactcgttgattaccagccaggtcgttttgccatattttgtcttagtttttaaaaatgctaatttttttgtttattctaatccagattgaaacgcgcctttaattccgcaactttttcattaattttcttttcacgtgctaacttgttttcagctttttctgtttcacgtacaagatttgccacatcacctgcaatcatttcagcacgcgccacttctttaatcaatgtgtcgaggctctgacgagcaattgggtctgcacctgctgcgattaactcacggtccaaagcccattcatcatcctcttcaacaacaattagtactgccgtatctccctcagaaaggcgcgttgccatgaacgccagcaacacctgatcagatgccacctgtgcaacatccgaatcagcccccactaaagctcccaacgtaccgccgaacaaaacgcccagcggaccaccaattaagccaattgctgaaccaaacactgacccagtcaaccaacccgaatcatcgcgggttgtaaatgaatcctttaatttaaagtcgtgttctccttgaaccgtcacgaggccagctgaaataatccgctcgttttcttttaaatccataaacgctttgtaagcttgctcatctttcggaaacaccgcaataacagcattcttttccataactcagtcccccaaatatttgataccgcaactatatcttgagaccaaattagcgtcaaaccggctcgttttgtcaccaaaaaaattcagcggacgccttattgcgattatgaacaaaaccaaccctagccagtcattacgactagctagggcggtgaatattaggtgatactatttttctaatgatagcaccgcaacatatggcaagttgcggtggtggttgttatagtccatgccataaccaaccaagaattcgtttggtactttcgctcccacaaagtcaggtgtaatacccccggcggacacatcatcacgcttgtcgaccgctaccgccaccaacacttgatcagcccctcgcttctcaaagtcagcttttagataacgcaacgtcaatcccgtatcaatcacttcatctaggataacgacggtacggccggctaggtcaaccttcaaatcacgttgaatcgtaatgtgaccagttgacgaatcccccacgtaactcgacacatcgatataatccgtttcaacgtcacggccaaccgcacgcagcaaatcagccatccaaatgtaggcacccttcatgactcccacaaaaacaggtcggtcaacatgtgccgttgcatcgttgatttcagctgcgacgcgttcaaccatcgcagcgatttcttcagttcccaaaacagtccgttgcaacgtcattgtttccatgtttttacccctcgttccagatatcgaatagaataatcgtttgctcgtttgaaggaccaactgcgaatgtgtacaatggcacaccaatcaattcttcaacgcgcttcaagtacgcttctgcattagctggcaattcttcacgtgactttaccccagtaatgtcatcatcccagcctggcaactcttcatagattggcgttacgcgacgcacatctcccaagcttgctgggtaatgctcaatgcgttgaccgtccaactcataagccaccgcaatcttcaacgtcttcaaacctgacaacacatcaagtgagttcaatgacaagtgcgtgaagccaccaatgcgggcagcgtgacgcaaaaccactgtatccaaccaaccgatacgacgtggacgcttcgtcactacgccgtattcgtgaccgatttcgcgaatgcgatcaccaacttcatcaaacaattccgttgggaaaggtccatccccaactcgtgacgtataagccttagcgacaccaacaacacgatcaatcttcgttgggccaataccagcaccaatcgttgcgccaccaccaactggtgaagatgacgttacgtatgggtatgtcccgtggtcaatgtccaacatggctccctgcgccccttcaagcaagacacgcttattgctatctaggtattcgttgacaatcactgttgtatccgtaatgtatggcttcaattgttgaccgtaatcagtaaattcggctaccaattcatccaaatcaagtggttcatgattataaatcttttccaacaactcgttcttttcagccaaaaccgtcgtcaaacgctcacgcaacacagcttcgtccagcaagtccacaacacgaataccagtacgtgcagccttatccatataagttggtccgataccacgtccagtcgtcccaatcttgccatcacccttacgtgcatcagccaattgatcaatcaaaatgtggtaagggaaaataacgtgcgcacgatctgagatacgcaaattatcagtcgttacacccttctcttgaataccgcgcaactcttccaacaatgccttagggttaaccactgacccgttaccaatcactgccaaacggttagggttgaaaatccctgaaggaatagctgacaactcaaacttctgtccgtcaacataaatcgtgtggccggcattgttaccaccttggtaacgcactaccatatccgagttctgtgcgatgaagtttgtaatctttccctttccttcatctccccattgactaccaacaactacgattcctgccatgatggcccccttaatttactggaacgttcgcaaaacacgaacatttcaaaacgttttatcacaaaatctattttatcaacaaacatttgaagtttcaacactaattagcgttaaagttcgatttttgacgactacttttaattcacactgttgattattcgtgttttcgtaacattcattacattttgtgcataataaaaagcgatacaccgaagtatatcgctttaacattaacgattattgcggttgacaatcttaatgatttcccaggcaatattcggaatcactgataagattgcagtgataatccattgtgcagtcgtcaaggcgtggaagtggaaaatctcttgcgtcaccggtaccgtcacaaccaacaaactcaatactgctgccaaaatggccatcattaccaaactgcgatttgctgaaaacttgatgcggaacatcgacttttcactacggatattaaagacgtgcaagattgacgtcatcgacaagacaacgaacgccattgtgtgaccagcttcaacgttacccgtccagacaccgtacccttgggctaacagcgtaatcacggcgaacatgatggcattaaaggcaatgcgaatacccaatccatgcgcaaatacgctggcctttgggttgattggcttctcattcatcacatcaccgtgcgctggctccttagccaaggcgaatcctggcaaaccatcagataccaagttaatgaacaacaactgggctgccataaacgggctgccccagccgaagatcatcgccatgacaatcacgataatttctgacatgttagcactcatcaggaagttaattgtcttacggatgttaccgtaaatgccacggccttcttcaaccgcatgcacgattgtcgcgaagttatcgtcggtcaagacgatatcagccgcttcccgggcaacatcggttccagtctgacccatggcgattccggcattagcagcattcaaggctggcgcatcgttcacaccatccccagtcatcgccaccacatcaccacgcttctgccaggctttaacaattcgaatcttatcctctggcgtaacacgggcatatacggcatagtcttggactgttgcatccaactgctcatctgacatggcgtgcaattcagcacccgttaatgccttatcagttggcaacaaaatgccaatttcacgggcaatcgcacttgctgtcgccacgtggtcaccggtaatcattaccgtcttaataccagccgcacgggcttccgcaacggcttgcgctgactctggacgtggcggatcaataatcccaaccagtccgagcaactgtaggttttgctccaactcttcggctgtcggttcttcagaaatcgtcgccaacttagtcatcgcaaccgtaatcacacgcaatgcttgatcaccaaattgctggttgatttctgttgcgcgactttgaacatctgctggtaactttggtaacaagacatcgaaggcgcccttggtaactgccaagtaaccatccgccaccttgtgtaccgtggtcatacgcttacgagttgagttaaacggaatttcataaacctttggatactcagcttgcaagtcacgataagcatcaacgccaccgataccagccaccaaggcgatttcagttggcaaaccgcttagttgcccatcttgcaccgtcacattagttgataatgcaccaaagcgaagtgcatctggtacggtatcaacttggtcgactggcacaacttcatctttggttgcatcccaaacttgacgcgctgtcatcttgttttgcgtcaacgtccccgtcttatccgatgcaatcacgctcgctgatcccaacgtttcaacggctggcaaacgacgcacaatcgcgtggcgggcagccattcgttgcacacccagtgccaacgtaatcgtcacgataaccatcagcgtctcaggtaccaccgcgacggccaatgagacggctgtcatgaacagctccatgattgggtctccttgcatgatacccaataccaagacaatcaacgctgcgacaatggccacaaccgttaattgacgacccaattgcgccaaacgcttttgcattggtgtcatttcacgttcttcggcaccaagcaaaccggcaatcttacccatttcggtttccataccagttgccacaacaaccgcttcggcacgcccattaacaatggttgtcccgcggtaaaccatgtttaagcgatcgcccaacggcacgctctcaccagtaataaaatcttcgtccttttcaattggttggctttcaccagtcaacgcagattcttcgacacgtaaatcagacgtcttcagcaaacgcgcatcggctggaatcttcaccccattttcaagaaccaaaatatccccaacaaccacatcagtcattggtacaaatatgacttcaccattacggcgaaccttagcttcttcgcgctctaagcccttcaatgaatccaaagccttctcggcacgtccctcttgcacaatcgacaagacggaattaataacaacaatggcaataatcaagaaactctcaaagtaatcgccgtgcccttgaataatagttgtcaccaatgaaatgaccgctgctatgatcaaaataattgttgtaatatcacttaaactccgaataaccttcttaaccagcccctcttttggcggttctacaaaacggttatccccatatttttcacgcgcctcttgaacttgagcgtcggttaaccccgtatcgggttgaacccgcatcttttcaatgacttgcgttaacatctcctgatatatcatatgtcggccctcctcttcgtcggcatatctcttctcagttacattttaacaatttccgttacttagacctaataatgtgctcaaattttgaaaacgttcgtattttgcgaaagattacacttgcatttcgtcatttgttcgtgaatttcgttgacaacgaacgtttcatcgcctaaactatgaaattgttacgaaagaacttattttattctatctatttgaggagatacagatgaactctgttgcaaaatatttccgttttggcgaactcggaacaaacttccgtactgagctaattgccggattgacgacttttgtatcaatggcctacattttgttcgttaacccaacggttttgggagccgctgggatggacaagggtgccgtcttcaccgctactggtgttgctgccgctatcgcaacaatcttcatgggattagttgcccgttacccaatcgctatcgcacctggacttggtgtgaacgccttcttcgcttactctgttgtaatcgggatgaaggtgccttggcaaactgcgatggctggtgttttgattgctgccatcatcttcttgttgctaacattcttcaagattcgtgaaaccatcatcaacatgattccacaagacttgaaggttgccatcgcagctggtatcggtttgttcatcgctttcatcggcttggctaacgctggtttgattgttgctaacgaatcaacaatggtctcacttggtcacttgacgtcaggtacatcattgcttgcaatcttcgggattattgtgacgttcatcttgattgccacacgcgtcccagctgccatctttatcggtatggtgctaactgcaatcgtgggaatcatttcaggtttgattgacttgccaacgcacattgtttcagccgcaccttcattggcaccaacgttcggtgaatcaatcttacacatcacggacatcaacacattccaattgtggacagttgttttgacgttcttgattgtgacattctttgacactgctggtacaatgattggcttggcaacccaagctggcttcatgaaggatggcaagatgccacgtgctggtcgcgctttgatggccgacgctgttggtatgacggcaggtgctattcttggaacgtcacctacttcagcctacgttgagtcttcatcaggtatggccgttggtggtcgttcaggtttgacgtcaatcacaactggtatcttgttcatcttcgctttgatgttctcaccacttttgacagtggtaacgtcacaagtaacagcaccagctttggttgttgttggtgtattgatggccgagaacttgcgtaacatcgattgggatgacttcgcaatcgcagcaccttcattcttgattgtcattggtatgccattgacgtactcaatctctgacggtattgcattgggattcatcttgtacccaatcatgatgattgctacgaagcgcgctggtaaggttcacccattgatgtatgccctagcattcatcttcatgttgttcctattcatcgtcgcccactaaacttgataaaaaataacgcccctagatgagttctgttactcatctgggggcgtttttatctgttattagtgtagttcaccttgaacggcgtttgtgtgcttgcctggaattgccaaaccgtagcgcgtgttacccaacacttgatccaccgtcatccccgcaaatgtatcgttaaatgcagccaccgcggcaaccaaatcatcagcatcaacaaaggcgtcgatagcagcagcaccgtaaacacccatgcggacaatgtccttcaaacgggcaacagtgataccacccattgcgacaacaggcaaatcactgttttgaacaaccgtcgtcaaccctgccaagtgctcaattggtgattcttccgtcacgtgacggcttgggtacactgggctaacactgtagaatgccaaaccagctggctcttcttccaacaactcagtacgattgttaattgaaacacccgtgtacaagtcagccgcttgtgcttgcgcagtcaattcgttcacttggtgacgatcggtaatgtacacaccgtcagctccaacagcggccgcgagtgcaacatcgtcggcaatcatgaaggcaacatctgcagtacgcgttacatcgcgaatgtactcagccaagttttgcttttccaccccagtcaattgtgcttcgttcaaaattaccattgaaacgccagccttaaccgcttgcgcaacgaagccagccacatcgtccacatattgtgatccaatcaccaatgtacttgctaattgttctgccttaaatgtcatgatacacctccgaaaatccgttattctttacatttgtaagtataaagtttttaaattatcccgacaaagaaaaaggaccgttttgcaacgatccgcttctgattatttcgtttgtttggtgcttgctcgccactcagttaacttcgtttgcagaatggctgccaacgccagatacaacaaagaaaatgcaccactatgtgtcactaactgatcgctttcaacatgcaacaaaattgatgcaatccagaaaaccacggtgcccacggttgcatgatgcgcaacatccccctcatcagtcacccacatttcctcagataacgtgcgtgcaatcgatagcaaccccactgatacaacggctatcaaaccgataatcagccacccagcagcgtttggattcacccaatcgttttggacagctgttccagcaataatcactccgatggctaaaatcaacgcatccaacttatatgacgccgtcaccaaccgcggttgccattgacgccaaacgatatatcccacatagataatcggtaatacccaattcaacattattatcatctcacacctcattttccaaaaaacggtcatccgataactcatcagatgaccgtttagattggactattgttgttctgcaaattccgcttgcaaagttgcttgctcttggcggtatgcattcacaagacgagctgtagcgccttgctcttgttgatcaatgaccgcacccaacgtgttcatcgcacgtgtgtagtcaaaatcagtttcgtagtagtaacgcgcttgttgcgttgcttgcacaacatctgcattatcacgatatgacaacgccttgcgtaccaaacgttctgtcactgacgcagcctcaattagtgcatcggtgttttcttgcaacgtatccaaatcagccgtcacaatgcttagctgacgcaaaacatcatcaacattaatacgtgacaacccaagctgttgcttcaaacggcctaactcatcgttcaccgcgtagaagaaactcatgtacgtatcgggcaaaccaggcaacccctgacgttcaaccgcacgttggatttggcgcaacttgtccgacaacaacgtcacgcggttacgcgattgttgcaccaactgtggtagctccttcaagccttcccacattgaaacttgttccttttcaatgcgctcaagctcttcgcgcaaaccgttttgcgtttctagcaagtgtgagaagacaacttcgtgttgtgaaattgatgccttcaattcttccaagctaactgaaacatttgaaagttggatttcccaactacgtacttgaccaacttcatccttagtaaagacaaaatcttgattcaggcggtccaactcaatgtacaattcgtgattttgacgcttgttgtgaacaacgtaagcagttaactgctcattgttctcccaaacctcttgcgctgaactagcttccttttcaaatgtttcgtacaacacttctgtacgggcttccatttgcgcaatcgtttcagtaacttgcttcaacgttaagtcagccagcaaatccaatgcgttgttgcgttgggtttcaagctcttcaagctcttctggaatatccgtttcaaacttgaatccttcagcggccatcttgtcatacgcgtcgtgcaattctgctaattgccctggcaacgtatcatccaatgacttgaacaaccctgggatttgttcaatgcgttgttcaagttggttcgtttccatccccaacgtctcgtagataccggcggccgttgcgtgatcaccagcttccgtcaaacgggcaaactcagcaaagtcatcttccaatgatcccaaaatttcttccaacttatcgattgctggtccgaaactaaagttttgtgacaacaacgtcttacgtaggtcttgatacttaacttcaagttccttcacggctgccttgtgcgcttcgtctagcttttccaaatcagacaaaccttgatttacaacatcaatcgtcatttcagcatcacgaatcaattgttgcaattgcttcaattcttgcgctgtcttcacgaagttcaagccttgtgattcgaatagaacactgttggcttggttttcaatttcattgaagccttgcgtttcaagtgtgccgtatttattctccaacaattggaattgcttaagtgattgacccatcaaactcaattgacgtcctttcaccaagcgatcacgcattggaatttcagctaattgttccttcttctgaagcaacttagctaccttgcgtgcagtcaatcgttgagagacaaagataatcaagtaaatggctgctacgacaactatcaagccaattacgatatgtccaatctgtgtcatactctacctacctttggcgacgcctaatcgtcaccaagctccttactattcgggaattatctacatattagattatcacgccatcggttttacaaccgctttttttgccccgacttaggttttacttggcgttctttaaccttttttaatcgcgtttacagattatttgcgggcaaatatatatctcatgacattttccacaaaaagaccatcattaaccactaaaagttttccacattatccacaagtgccaaatgaaacatccattctcttgtggataacctgtggatagttttgttagaaaatgagattttgatgataacaatcaagctagttttccacagagtttccacaacgcgtccacaaacttatcaacaagttatccacagttgttaatttagatggggaacaaaaggtcagtattctttaaaagagttggtaaaaaataaagcactgacaatagtcagtgctttgatttaacgtctaaaacagcgccccatctgcgatttcgcccagtgtatcacgcgatgggataaagaatagttgacctgattggatggttgagaacgtcaacaaaaagtcggacatatccaccatttgttgcaacatcgccttcgtcactgaccagtaacgtgaataaccaataaagtaggtccccgtttttccggttgctggatcagaaaacggcacgttcatacggacaattttttgctcttcaccatcaacttcaatcttagcagcgacattatgtgcattatgaaacttttcatcatcctctagttccaaatcatcaaacttatgacgacctaccgctttttcctgttcttctgttttcattttgccccagaagtccatgtcatgcagccacttttgggcaaaggcgtacgacccattaatatactccgggtcctcctcccctaccagcgcataatcggctgcttcaaattcagccggtgcttcggtaccatcaataaagccaataatggcgcgtccttcaaaataacggaaaccctttgtctcatcaagcacggttgcgattggctctagaaagaccatgaactgacggacgacttcgtacaccaccgcctcatctcctgcgcgaacgtgcaagaaaatgtcgccttcagatgccggcatactatattctggtcccgtcaatgttgtgtaggtttctagttgcttaggtaccgcagcattcgggaacagataatcccatgccgttcgactgaacccaatcgatactttcaaattcgcatccgctgcccgaatcatcatcgagcgttcaatagcttgcgaccgatcagcaaactcagcaatcgcttcttggtctgctgccaaattctcgcgctttaatttcaatacgacgaaagacacattctttcccacgtctttccatacatcttgcgccttagttggtgttactggcatgatattatcccccaaaattatatcgttctgaaatcattataatccgggcgcatgccaattactgtttccaacacttctatataaaaaaacaccgccaatgtgcggtgtcaggtatgtatccgggatgtaacccggttttccgtgaatagctgttttcacggacggaaagttaaaggggcaccacagcgcggtgggaaacaggttaggcttgttagcgccatggtgccagctgcgactcatgttcacaacttagagttgaatggggtttcaactctacccttaatcatacaaatttatgacccagccaaataaaacttcccgatacttgcatcatcagatattcgcaatcgtaaagatgcccatttttcggacgtcacttttcccagtatggacgcaagattttttgataagcatccgtaaatttgctatctccggacaggatgacaaaatctgacaagtgctcttgtaattggcggcgcgccgtcggtacttcatcaatcaagtcttcatacagttcgaacaaccgacgttgacctcgcccaaacaacggcacatctgccggattgttgttaacgacccgtgattccttaagtaacgactttgccaactctttattgtgcaacagcatcgcccgtaaaatcgcccactcataaatatccaagactgcattgtgttgaatgtattgctggtccgcttcatttaaagctttgcgaatcgaccgcgaccacatttcaacacctgctttagtatcgacatgaagcaaggcatagcgcattactctgaactcagcagcatgccaaacttccatgcccattaattcgttgccgatttttttactcaactcatcggcagcatcaccctgtagccaattgcgacgtacgaacaatccatccaaagatttgaattcaaagtaagcctccaaatctttacgaagatgggtttcttcgtaaagcttctccattgaacgtgccatggcatcgtaacccaacggattaacatgttgccaattatattgatgccaggttgagttcgtcacattaatcacacggcgacgcatcacggcatcgatgtcactcggcatcaagtcgaccagtcgcatcaacgtaattaactcttctaactccagataatgcgtctcattataggttcgatacaacttgtatgttgaaataccagcatccaccgccatacctggcgtaatatgcttttgcttcatgatgcgacgcaatacatccccaaagtgttcaaacagttcttctggtggcaaggttgaaaaccgcggaaacgcatcgtgctcatgacgccttatccaaaaactagccgtcgacacttgaatttcattccacaatggcagtaagtcaactgaaatcaaccgcgttttaacagtctcaacatgttgattcttcacagctagcaataaaattgtcatgcgactcgtcgttgtgtataacaacccctcaactgttgttttgaacaactgcatcatttgttgtaaaattctcagttccatgaattgtggctctgagtattggttcaagatagtctcaatcacaaacattgaattgtcatagctacggttttccggttgcaccagcaatttatcgacagccgccaaatgaattgtcagcaccgcgtcatacatgtcattcgttaaatagttttgaaagttcgacatgcttcgtgcatagcacaaatacaatcgcttaaactgccccactgttagttccggggcaataacagcaaatgcaacgatatctaacagggtaaagatatcaatcgttaccaagcgctcatacatttgcgtgaccgcttcctgcattgattcacctttgcgcaatgccaccaccgcttgaaacaacagtttacggaagtccgtatcttggtcatcaacgccttgcgcccgttgggttagttcgttaatgtctgcgttcattaaccaacgaatcgaaatgtcttgaaagcgcgacttgcctgttaatagtcctagttcactgaatgaaattgttaacgcgtccatgattgacatcatatcaatcatgctcatgtcaatttcaccttctatgaaacgataataccgcgacttactgatgcctaatgccacaatttctgccaaggagacccgtttttcgcgtctaacttcattgatcacctgaccaattgtccttaacattgttagccttactcctctaaaatactactctctaaaaaaacggcttaaaacgtattcgttttaaacaggcccacaggaagttgttaacccagtattagtaataaagattgaggttaatgggctaacaacctcactcattataacgactaaacgtctttatagatggttattcccgttaattaatatagtttacttactatttaaccaaacatcgatagccaacgccattaaaacaacctgcttctaatgaaaaacggacccggcaatctaattgattaccgagtccgttttcgtcatcgcctacttagcatagaatcgtgttggataaaagataaatgccactaacttcaatttctttgacagccactcgccaaacaaactaactgccatcgcaaccataaagacaagtaccaagtcgatcaacagattgttacctagcaccttcatcaccacaatacgagcaattgatacaaccggtgggtgaatcaaataaatgacaagtgaaatcttaccaaagtaacgcaccacatttgaaaccttgtctgtcatttcaccaagccacatgaatattgcaaagaagactggaatcgtcaaaagcttaatcataaaattagccggtgtaatgaagttcgtatcataaaaccaagttgacgcaccttgcaaaatccacaaagcaataatcagccccaatgacacaacacccagcacagccatctggccacgctgcaactttgaacgtagcaagtaaccaactaagaatgttgcgccccaaagtaccgtttggttaatcgcatacaacgttggcaagaaacccaaaattgccaatgcaaacagtacggtgtataccaccagcagcacagctttgcgcttaatcaccaaagtcaacgcaccgaagagaaccaagataaagaagtatacatacaagtaccatagatacccaactggcttgatgccaatgtacaacaaatcaccgattgcgtatcgatcatgcactgtagatgatgatagattttgcaggatgacgtagacaaccgaaaagacaacatacggtacgcccagcattaccaacttctttcccaaccctgttatgtattgacgccagtcagtcgaaggtttgaacaagtaccctgaaatagcaaaaaataccggcataacgaacataaatagtacgcgttgcgacatttctagctccatagctgctgctggaaattggccggttttatatagtgaaccaatcgtatgaactagcacaacactcaaaatcaggatacctttcccgtaatcaagccagcccacccgcttctttttcgcgacagatttttccatatttttctcccaagcgttggataaagcagcgtggtcacgtcggatgtttagaccaacagctgctgtgataaatttaattgtaccatctgacgcaattcagattatgcctgcttcgaaccctcagaatgccacaaaaaaagcacgaaacataatcgtttcgtgcttctttgttgtacaacaagtacgaataataaaattatcccaacttgttgtagtattcaacgataaggttttcgttgtaatcgtggtccaattctgaacgctctggcaagcgaaccaatgaacccttcatctcgtccttgttgaactcaacgaatggcaacgttccagccgtagcttccaatgaagcttggatgtaaacgttcttttgtgacttctcacgaactgagatctcttgacctacagtaacttcgtatgaaggaatgtcaacacgcttaccatcaaccaagatgtggccgtggttaaccaattgacgtgcttgttgacgcgttgaagccaagcccaaacggtaaacaatgttgtccaaacgacgctccaacaatacgatgaagttttcaccgtgcgtacccttacggatcttaccagccttgttaaacaagttgtggaattggcgctcagtcaaaccgtacgtgaaacgtaccttttgcttttcagccaattgcataccgtaatcagaaatctttgcgcgacggccggcaccgtgatctccaggggcgtagttacgacgagcaatttccttaccagtacctgacaaagaaacacccaaacgacgtgaaacacggaacttaggtccagtataacgtgacatattaaatgtcctccagaatttatttttgttgaattctagagaattgcctcacattcgtgcaattcacccaaactttcaccgctgcagcgcgggtactggtgtgttctccgccataattgaaacgggtcggtgaattgttgacgagcttgcggacaatccgctgcagttttcaacacttcaattagtttaacaaaaaggaagaacaactacaagcattcttcctaactttatctctttagttttgctttgaaagcgcatcaacaatgatgcgacccaaaacaccaacaatgaaaataccagccaacatagcaccggcaatttgcaacggcatcgtaccaaacttagcaggaccgccattcaagctcaaaataatgattgaaatggcccaaccagtcaaccaagctgctgtatccacccagttacgaataccaggcataccagaaatcaaaacagccaatgcacctaggacgaacaaggtcacaaacagcgttgtcttaggccaaccagtcaatcctgggaacgtgacagccatcattccccaaggaattccgagccacataccaaatagctcacgccacttgttcttaggatcgttacctgatgccacaaagaaaccacctgtaatcaaggcagcagctccaaccgtcacaccaacaaacggcgctgcaaccgcccaacgtgatggaatggttgccacaaacaatgccaaagcaattgttggatttaacttatgcatttctctatctcctacgcaaacaatgaataataattactaacggtaagtaattatacacgctttcggagattgtgcacaaaaaacggttttagctaaaaaacgcctacatgtaggcgttttgcttgtgattatttttccaaaaagaattcgaaacgagacccaacatattgggtacgaacgtactcgaatgggcgattgtttgtgtcaaacgtaatttgtcgcatgactagtaccggatcgccacgtttaatgcctaaatattcagaaatacgttccgtaacagccgccgcggtcaccgtttgttgtgcgcgaccaatctttagaccacgctcttcagagagtgtacgatacagtgaattcgtaagactttcacgtgccaaaccgtcaaccaaagttgctggaattgaggcaacttcaaacgcaattggctcatcgttaccgtaacggacacgctccatgcgaagcacttggccatcctcacctagttgtagttgctcttgttcagagtttgataccttcccgatatggaaagaaatcgtgcgtgatgttgcaaccttaccagctgctgccatcatttcagtgaatgacgtaacgccgttcagttgttcttgcaccttgcgttcagcaacataagttcctgacccaactcggcgttccaagacaccttcgtctaccagcatcatcaccgcttgacgcaatgtcatgcgtgagacaccaaattgttcagccaactcacgttcagccggaatcttgtcgcctggtacccaacggccagcttcaatagcttcactgatttcatcgtgaatttgaatatatacgggtgcgcccatattagtcctccgcagtcggagcgtcagcctttgagaagtgacgacccaaactataagttgcttccaaagatgtcaaatctgcgctaaacacgttcaaatccgcatccttgccaatcgtcaacgttcccttgtttgtcaaaccaaactcaatggcttggttaactgatgccatttgaatcgcttcctcaattgacgcacccgtaaaggccatcacattgcggaaggcatcatcaaattcaagcacagatccagccaaagtaccgtcttcaaggcgagcttgcttgtccttaacccaaaccttttgaccacctagctctgattcaccgtctccaagtcctttggcacgcattgaatccgtaatcaaatcaatacggttagccgtcttcaacttgtaggccacgttaaccatgtcagggtacacgtggaaaccatccacaatcaactctgtgcggatgttatcttccagcatagcgtgtcccgttacaccaggttcgcggtgtgacattggacgttgtgcgttgtacaagtgggtgatgtggcttgccttagaattgtgttgcaagaaatcacgtgttgcatttgagtgaccgattgaaccgataatgttgttatcagctaggtaatcctcaaaggcacgcacgtcttcagcttgctcgggtgcgtacgtgatcaaacgtacacggttacctgacaattcgttccacttctttaccaagtcaatgcttggtgcaatgatgtgttcctctggttgggcacccttgaagtgagggttgataaatggtccttccaagtgcacaccaacgattgctggttcttgcttggcagcttcatttaccgcttccattgactttgagatattgtccacagcttgtgtcattgtcgttggaaagactgacgtaattccttctgaaatttggctgtgaaccatcttgatgatatcttctgtgacaccgtccatcgtatcaaaaccgtacgcaccgtgtgtgtgtacgtcgatgaaaccaggaacaatcaccttacgatccgcgcggacgacattatccgctgacgtcacaaccaattcactcattggtcccatcgcttcgatttgcttgtcgaaacggatgtaagcatccttaattactggcacttcttgttcgccggtatagatagttgcgtgtgtcaaaactgtactcatgatgaactccccttgtttatagaaaaactaaattggtacaggcggttaaccaccgtctctatcatgttctaatcgcttacaagtttacacggtctagttgatttttaaaagtcataactcgaaatatagcagattgtttccattccaaataaaaacaaccatcactcatatcagctgatggttgtttacaattttcacttcaagaattcaggtgccaagtaagcggggttagggtacttatagaacccttctcccgattcaacaccaatatgtccagcatcaatcattgtcttgaccttcttggcaatttcttggtgtgatgtttctgggttcatgatgttaatcgcataaactgtattcaagccaaccgtatccatgatggcaaatggtccagccggagcaccagtagcaatcatccaagtcttgtcgattgtctctggatccgcaatttcatttgcccacagttgtgaaccagcatccaacaacggcactagcaacgagttcaaaacataacccggttgttccttcttaaccataattggcaccatgccaatttcacgtgagtattcctcaaacgttgctggcaattcaggtgcagtgcctgggtgtggcatgatttcagccgtgttgttcttccaaatttcgttagcaaagtggtaagccaaaaacttttctggacgaccagtcgcctcagcgaaggctgatggtagcaacgttgaagagttagttgccacgactgtttgtggatctgccaacttcgcaaacttttcgtagaactcagtcttggtggcaggtgcttctggcaacgcttcaatcaccaaatcagcgccagcaagtgcctcgcccaaatcagtgacatacgttaaatgctcgcgggcagctgcgatttgttcgtcagttgcttgcaagtcgcgacgtacaccgtcttcccaacgcgcaacacgcgcttgtgccttttccagtgaagagtcagaacggccccacaccgtgacatccttaccgtggaatgctgatacgtaggcaatttgtgatccaagtgttccaccaccgacgattgttactttttgatatgacatgtgataatcccccatcatttttgattaactacaccatatcatgtaagcggtttctcatgccaaagaaaactatcgaaaacaaaaaagcatccccacaaattgtgagaacgcttctgaaaatctatctattagtctgcagacaatgcatcgattgggttcaactttgctgcgcgacgagctggcaacaaagcggccaagaatgagatgaccaatgccaaaatcaacgtcatgaccacatttccaactgaaatttgaatcatgtcaaacttcgcaatgctgtacaaagctgaattcaacaatgagccaattccgaaggccaaaattagggccaaaacgaaacttgccaaaccgattagcaaagattctgacgtaaacaagttacgcacatccttcttgctttcacccaaggcgcggagaattccgatttccttcgtacgctctgaaactgacatgaacatcgtcacgataatcatcaaagcagatacgaccaatgagataccagcaatggcagccaagacattcgttgccaatgagacaattgtgttaatagtgtccaagattgacccaaccgttaccgcttggaacaaacgcttgccatcatcacccttcatcttgttgatgtccttttggaaggccttaacatcgtcagtgttcttaacacgaaccgttacgaacaacgcacgggtatcggcaccagcttccttgtaggcatcttcaatcgtgcttgctgtcgttacgtttgccgttccagcttgaccagcgtcgataacacctgcaatcttcaacgtcttgttaatttcaactggcgtcataccgtctgacttaactgccatccacttaaccgtcatcgtcttaccaacaactgacttccagtccttagtatcgaacttcttggcaaccgtcttcttatcaaccaagatttcgttcttgccaggtacatgacccgccttaatcaacttcttttgataagttgctgaccaagtttgcactgtcccaagtgagtaatccttaccttcaagatttgcttggacattgccggcttggtaacccttttgcaacgtcttcacgtacttgttagccttaattttcttgatttgatcatctgaaatggtcgtcttgtccatatcgacaccggctgtcgcaccagacgtttggccaacgccaccgttttcaccttggtgacgggcgaccgtaacagccgttgggtttgccaatgagttaacttggtcgttaatgtaggccttaaccccatttcccaaaccggtgaacaacatcacagcaaacaacccgatcgctgttccaatcataatcaatgagttacgccagaagttatacgttaagtgcttgaacgcattacggaatgacgcagctgctggtaatggacgatctgccaaacgcgtatcatcagctggcaactcgtatgctggcttcaaacgtgtatcggcgtcgatttgaccatcagccaagtgaacgatacgcgttccgtggtcagccacttcttgtgagtgagtaaccgcgataactagcttaccttcttgagcaatttcgtccaagatttccaagacttcagccgtattctttgaatccaaagcaccagttggctcatcggcaatgataatcttggggtcagaagccaacgcacgcgcgattgcgacacgttgcttttgtccaccagacaattggtttgggtgcttcttaatttgatccttaagaccaaccttctccaacaattcggttgcgcgcgcagtcttatccttttgactcaacgtcgtcatttccaatgaaaccaagacgttctctaggacagtcaagtgactaatcaagttgtaagcttggtagatgtaaccaatcgtgccacgacggtaagcatctaattgcttttccttcttgtggtccaagacttggccatcaatcgtgaccttgccttcaaactcgcggtccaaaccaccgatgatgttcatcagcgttgacttaccaccaccagattctccaaggattgaaacaaactcacccaattcaaaatccaagtcaattcccttcaaaacaggaaactcttccttacccaggtagtatgacttgcgaatatcttttaactctaaaaatgccattgtctctcctccggctctctacgctttttgtcatgataattgtaattaagtttaccgccgtattgaaatggcgtcaagaaaagtttaatcaaaatgcctttgattaaactttttatgttatagtaattttataactactagcggaaaggtggcacaccatgaatcgtgaagaaaaaaaggcgctcacacggcgacaaatcattgacgttgcgacgcgtttattccgacaacacggcatccataataccgatttaaaaacaatcgctaccgaggctggcgtgtccgtggtcaccttttacaagtacttcgatagcaaggatgccttgattggcaccatcgcggccgagcaactcaatacgttgttcgatcagattatggcgattaccaaccaaaccgatttacgctttatcgaaaagattaaagccttcgcccaactgtcccaacaaaagcagcaagaaattgcgaatacatttggggatgaaatgatgcaactgcttgaaaaagacgattcagccgttcgcgcagttgccgagtcacgccgcgatgaatttttcgaagcaatcatcgagcaaggccgtgacgaaggtttctttaccaccaacgttagcacaaccgctattcgcgtgtacattgatatgtttgtgacttacccaaatgttcaagctagtttggcttcaaacagtgatttaacccggcgtgagttggatgcccaattggaagaacttttcttcttcggcttgatgggatcagtagacgccgcccaccgcgaccaactaaatgaaatccgtaaacaacaaaagggatgagcaactgctcatcccttttttgcgattgtctgcaacacaccatcatgattgttatccgcaactgccacagcatacccatatgcaaataggcgcttatcagcgttgggcataatcaccggttgaccggctactgacaacatttcctggtcattcataccatccccgaacgccattaagtcagccggttgaccgcccaaatgtgccaacatccgttccaagctcactgccttattgacaccagttgccatcacatccaccaccccattaccaggtgtcgtagcgtgaacgtcaataccactctgcttaacttgattaacaaacgtttcactttcagctaacgtccaaaataccgtcactttaacaaccggtacgtgcacttcgcgtagtgacacgacttcacgcggttacccgtataattcagccatcatcgccacaaacgccggtggtacttggccgtagtcacgcacaaccagtaattcatctgggctaaaaatcatcaccccaccatgtggttttccaggcatcaggtcgatttggtcttgcaaatctgctaattgttcaggcgtcatcgtcaagcggtctgataactgttggtcagcagaaagcaacgttgcgccattatcagccacaatgttgaccttatccaaaaaaccaccgaataacatctgaacgtgtcgcaaatcacgaccgcttgccacaatgaattgaccaccctcagccgtataagcgttaataacctgcgcaaataaatcacgattgtattgctttttgtcgtttaaaaacgtgccatctaagtctgtcgccacaaattttgccattatgccacctcacttcatgtcatctagcttaatcctatttattgaatattacgttcgaaatctatcaacttttgtttccaattttgaccagctcggtactgtcccagtgtcccatcactgcgaacaatacgatggcaccccacaaatactagcaatggatttttacccaccgccgatgcgacagcacgtacagccgttggtcggccaatctgattcgctaatgtcgcatacgtcatcgtctcgccaaaattcgtctcaactaaagcgcgccaaacttcacgctgtaattctgttcctcgcccctgccagtcagttgtgaaatcaaccctgcgaccagctaaatagtcagacacaaccgacccataatggcgttcctgacttggcttgaccgtcatttcaccaaaccaagcttgatagtcagctaccggatcttcagccaaggacacaaacgtcatccccttctttgaataaaagattgtcaagtgaccgcctaaaaagtcgtacgtttcatattgcatatcatcatctctttcaaatgaaaaaagctactcgtaatcatcgtttacgagtagcttaccaaattatttaaatgatttcttctagcttagccaatacaccatcatgttcgttgtccaagtcagccatgccgaacccgcgattaaacaaacgctcatccgcatttggcatcacataaacttgtccagccaattccatcatttccaaatcattcatgccatcaccgaagacggtcaattgctctggtgccaatgatagcttgttgatgagtgccgacaaactcgttgccttattcacaccttcagccaaaatatcaaccgcaccatatcctgacgtcgttgggtgcaacggcatccctgatgcgttaatacggcgaatagcttcatttgaacttggcacgtcaaagatagctgtcacactggccaacggttgcggaatatccgttaagtgatcaaccaagtgaattgtaccgtacacatgcgtcatatagtcttgcaagtctggtcgcaattcgccgtatcctgacaaacggtacatgttgtcttcagagaaagcaataatgccatcctttggtgaaacatcaactaagatacgttccaactcagccaacgttgatgcatcaagtgtacgtaagtctgtttccgcagtaccacgaacgtgccaggcagcaccgttatttgttaccaagtggacgcggtcagctaatacgccaaacttgctacgtacccactttgcttcgcgaccagttgcaatagcaaattgatcaccgttttcatcgagttgatccaaaatcttagcaaatcgttctgcatcaaaggtcttatcttcgtgcaaaaatgtttggtccaaatccgttacaaacaagcgtgtcatgataaccgcctccactttccttatgtcagtaataagtgtatcaaatcgtctgcctttgtagctgcctaaaaggaacaaaaaaggcgattgctttcgcaatcgcctttcgcgtatagcccatcagggagtcgaaccctggatgccggtgtgaaaaaccggagtcttaaccgcttgaccaatgggccatgatgttttaacaacctgtctcaacaacaaaattaatattaccagaataacctgaccagtgcaacccctaattttaaaactcgcaaactttcttccatagacttccgaccatacggtataattactgcagaggaaattaggatgactgacaaacaacttgcccacccaaagtggttgctctttttcgaaacgttaacagccatcggcgttatcgtagccttattacgtttctttgcatcacttatcaatggtatttatcatcactttaccggtcacacgtttgcattcgttgaggcagtcaaacaaaacacgtggcaaaattatttgaccctagcgatattgattattggtattttaggcacccgctatttgaagacaaagtttaagtaaaaaggacgaccaatcggtcgtccttttgctttagttattcgaattcagcattcttcttcattgtggcgttaattgtatcagccactaattggttaagatgtccatcttccagaacttgccatccagcagccgttgaaccacccggcgtcataacttcgtgcgccaatgtcattgggtccttcttgaattcttccatgtgacgagccgtaccaataaccgtttgctgtgccaatcgttctgccgtttctggattgataccagcttgcacaccagcttgaatcatcgcttcagcaaacgccgcaacgaacgctggaccagaaccagccaaggcactgacagcaccaaattgctcttcaggtaattcgtctgtacgaccaaagtccaagaacaaagctgcgatagcccccttgatatcagcgtccatcgtgtcatcaaaagccaaagctgtataaccatacttaagcgccacgttcacatttggcaacgtgcgtgcaatcagaacattaggccccaacgcagcgtgcaattgtgccaatgaaacaccaccaagaactgacgccacaataacacccggcttcatcatcaatccgagttgtagttccttggcaacgtcagtcaattgtgcaggtggcattgccaaaacaaccatgtccgactcagcccaaacatccaaagcagactgcttagcctctaatcctaattcagctgcaactttttcacctgaatgtggtgaaaaaagcacttggcgaatttcgggctttccttgccagccttgcatcatcgctttagccatattaccagcgccgataaatccaattgttaacatctcacacctcgttcatctcgtttgtaatgacctaatcatatcatacctagatgatataagaagcgacccaccgttttgtttttggttgtcattcaaaataaaaagacctcgaaccaaatcgaggtcttcatgttcattatgagaacccttggcgttcagataatgagaatgctttattgtgatagcgcatcgacataatcaaaccgatacccaacatatttccaaccaaggcggaaccaccctgtgaaataaatggcaacggaataccagtcaatggcaccaatccgatattcataccaatgttttcaaaaatgtggaacaacaacatcattaccacaccagatgcaatgtatgcatagaattgatttgacgtatcattaacaacttggaagatttggtaaatcaacaagaagtaaagaaccagtagcaagacacttccgacgaacccgaaattttcaccaataactgagaaaatcatatccgattcacgaactggcaccgcaacgtgcgaaacgttgaagccagttccggtgataccacctgatccaatagccttcattgcttgccataactgataaccactatttgacgtatcccctgaaggattcatccaagcgtccacacgggcaaattgataagcttcaaatccaaccttttccagaatgtggcgtccccatgtttgggtaacaaacaggatagttgttgttcccaaaactgcggcagctccaacaatcggccctaaaattgaccaactcaaaccagataccagcgtcattccgaaaacaattgccacgaacaccagtgttgttccaaagtcgtgttgtgctagaacaagtacgacaattggtgccgtccaagcgataatcttcaacaacaagaacttatcagaattccaagtgtgctctgggttttccaaattatgctgtgaaatcacacgagccaacataataatgaatgctggcttcataacttcggaaggttggaacgtcaatggtccaatagcaaaccatgactttccaccagtgttagcgtagtaggcacgtgagtaaaaaatcaaaacggcaaccatcaagaagacacctaacccaaaaatataaggggctactcgccaaagttgctctgaatcgaatctcataatcaccatgactgcaatgattcctacgatatagtaagcaccttgcataatcaccatgcgccaaacgttaacaccaacagtatcatgtactcccgcaacatataatgatgctaaaccaatcaacgcaagcatcatcacaacgaagatgattgaccaatcaatcacaccaccttcgctcgagaaaaagcgtttgatcatgttttaacctctttattgattagtgatgcaagttaaattctgcaatcaacaattccattgcgtcatcaaatgacttagccgtaaccgtacgattatcagcgaagcgtaccgtcaaaggtgacgttgactcatcaatcgtacccaaacgaaccttgttcactttcacttctgaaaggttatctcccaaatcattaatttcaactgaaacaggcttattattacgtgacataattactttccttgtactccgtgcatgtgttctagcaacttaccagctccaacggcaacattgtccaatgggctttctgaaatcataacaggtacaccaaggtgtcctgaaatcaacttatccattccgcgtagcaacgcaccaccaccggtcaaaacaacaccgcggtcgataatgtcagcagccaattctggttggataactgacaaaacttggtgagcagcattcacaatttgtgccaatgtgtcgtgcattgctgcctcgacttcgttagcattcaatgtaatcgtgcgaggcattccagtgaagttatcacgtccacgcacttccatctcttctggatcatccaatggcgttgccgtaccgattttaatcttgatttgttcagctgtacgctcaccaatttgcaaaccgtgctcacgcttaacgtagccagcgatgtcagcgttcatcttatcaccggcaacacggattgattctgacgccacgatatcacccaatgacaaaacggcaatatctgacgttccaccacccatgtcgatgaccattgaggcaattggtgagaagatatccaatccagcaccgatagccgcaacctttggctcgtattcaagatacaccttaccaccaccagacttttcagcggcaccaataatggccttacgctcaatctccgtgatatttgttggtgcgcacaccatgatgtttggtcgtgacatcacacccttggcgttcaacttagccatgaagtatgacaacattgcttccgtcatatcaaagtctgagataaccccatccttcaatggacgaacagcgcgaatgttaccaggcgtacgaccaaccatttgataggcttcggtaccaactgccaaaaccttatccgtcttagtatcgattgcaacgactgatggctcgttcaatacgataccttttccttcaacataaatcagaacgttagccgttcccaaatcaatgccgatttccttggccatgattttcacctcttaattttttaccgagcaagctcgtttacattcttttacgtatctataatagtatacaacaaaaaccgacgtcatttgcccttagtttctacatcagggtaaaatagacagaaagacaataaaaggacgatattcaaaatgaaattaacccttaaagaaatggttacagccctaaccgccagtgtttcaaccgaggcggatgtcactgtaaccagcacgacatttgattctcgcaaagcaaccgctggcagcctattcatcccactagttgccgagaacgacggtcacgattatatcgctagtgccatcgcaaatggcgcaaccgctactttgtggcaggcagatcatggtaacgtgccaacagatattcccgctatcattgttccagatacgctagatgcctttcaaaagctagctgcttactatctaaagaagatcgccccaaagattgttgccatttcaggctcaaacggaaagacaacgacgaaagactttattgcggctatcggtgccagcactttcaagactgtcaagacacctgctaacttcaacaacgaaatcggtgtccctacaaccattctttcaatggctgaagacactgaattattagttgttgagttcggcatggatcgtcctggcgacttgacgctactatcagaattggtcaacccagatattgccgtgttgacaatgatcggtgaagcccacatcgaattcttcaaaactcgcgaccgaattgcagatggcaaaatggaaattatcagcggtttgaagcccaatgggttgtttgtctacaacggtgacgagccactacttcgtgaacgcgctgcacaacacgaaaacctccagacggcgactttcggactagcacctgagaatgatttattcgcttcaaccattgaaatgaacccggtcgaagcaactttccaaacgaatcaaacggatgaagccttccgcattccactaaccggccgttacaacgtttcaaatgccctagcagccatttcagttggtcgtgcattgggaattgcatatgacaaaatccgcgatgcgttggccaatgcgccaatcaccgaaaaccgtaccgaatggttagatggtcaatttggtggcaagattttgtctgatgtctataactcaaatccaactgctgctaaggaagtgttgcacttcttcgctgagacaccaacacaaggtcgtcgcattgctgtacttggtgatatgttggagcttggtgaagccggtccaactttgcacgctagcctagctgatagccttgaaccatcagctatccaacgcgtttacctcgttggtgatatcatggccagccttgaagaagcgctaactgctagctacccagcaggagctgtgattcgttacgctaaagataacttgccaacactgatcgatgatctaaagtctgagttaaccgccgatgacatcatcatgcttaagggttctcacggtatccaccttgagaacgtggtctcagctttgatttaaaactcaattgcataacacaaaaaggactatcgcgagatgtgcgatagtccttttctttttaactgaatacttactcaacttcgggttgtcgttgcatcatcactgggaacgagttcttcatcccccacaatgcaactgcaccaccgataattccaaagacaaccaatgcgattgtcgccgcccacacactcatatatggcgtgtgattaattaaagcatcgtaaccttgagctgcatacgtcgttggtagaaacctagcgatcgtcgctaacgttgcattcaagaattcactcggcacaatttgacctgacaaaacaatttgcgccatagccacaataactgaaattagcaaaccaaccgtgccaaacaaaacatccaacagtagcgttacgagcatgaatgccgtcgcaacgatgaacgtaaacaagaacgttgctaacaagttagcatcaatcttgaaaatcgcaataaccccggtcatcaagacagcttgcaatactggcaaaataaacaacgtacgcaaaccagcaatcgcggatacctcagcagtcatacgacgacggcgctcattcatctgaattagcaacgcgccaataaacaatgcagaggccaacaacgctggaccgaaaactgccttgtaatcagcaaccgtcatttggcgatcaacttgctttgaggcaactgggcttacaaagtgattaattgtcttcgaaccaagatggattggttgtagctgcttcacaccagcttgtaacccatcattcaacgtcttagttcctgtcacagcagtcttaacaccatcatttaacttatcatccccagttgccaattgttgggcacctgaacttgccgtatgcaacgcatcaagtaacgttggcaccttgccagccaacgtgttcacaccggctgacaattgactagcaccacccgctaattgttgggcgccatttgaaagtgccggtgtatttgcctgcaattgatttaacccatcagacaattgaccaaccccagcaacaaggttcggcgtcttattagccaattgttcattaccagttgcgacttgactggcgccactagcaagttgggcaaccgcgacattagcttgtcccaatcctgtgtacaaagacggcatcttcgcggccaattgttgttgtccgccagacaaagtgaccaatcccgtttgcacttgcaacgcaccggcagacaattgttctgctgatgaggctagtttatcagcccccgcaacagctccgtcaagctgtgatgcaatttggttgacttgcgttgaaaacttatcaatcgcttgtgatgcaccagaagttgccaattgaccgtttgttcccatttgttgtaacgacggcaatagcgctgacaactgtggtagcaatggcactaatggtgttagtgcatccccaacttgttgcgcttgtgtctcttcatccgtcacggtgcctacttgttgcaacgctgtcatgtacttgcctttgaactctgcattatggctgtcattcaagaatgtttgaaattgcggatcatccaccagatccttaaaagccccagcaccagcaccaactgtggtcaaatccgttttcaggttagccatgttcgtcgcgaagtcgaccttaccggcatcgccaaggctaagccctttcgtttctttcgaaatttgacccaatccgtcgtttaattggttcaaaccggccgtcaacttttgcaagtcagccgcattagttgcttggccttgtttgattgttgttaaaccagctgacagttgcgttgacagttgctgtgcaccagccgctagttgttggttacctgaagcaacttttgtagccccagcagtgaggctttttgcaccatcacccaaagccacgacaccatcgctggcagccttagcccccgcaacaagcgccggtgtatttgaagctaattgattcaatcccatcgcaacttggcttgaaccgctcgccaattgttgcgtcgctgctggtaacgcgccaacgctatcacgcaattggttaccgccatcggccaagcgatcaataccagttgacgcatgtcaatcccgtcggccaacgtactagcaccagtggccaatcgatttgaaccaccttgcaattgcgaaaccccatccggcaatgcgtttgcgccagtttggatttctcccaaaccactggctagcgtgtgcaaattacgattgacttcaccagacccggaagctagttggcccatgccatcattcagttgctttgtcccagcagccgccttggcggtaccgtctgacaattgcttaatcgaccctaacaattctttgttgtaggtcttttggatttcggcagtcacttgcgacttcagctgttccgtaactgtatcggccaaaataccaccaatgtaatttgtgtgctttgacacttcatacttgatgtttgacgtctttggttgcgcactaagcgccgtcaacgtgttggccgtaaaatccttaggtaacgtcactgtcatcaatgtatcaccgtcagctagtgcacgtttagcttgtgggccagacataaattcccaagcaacactatcattatgacgtagcttatcaacaactttttggccaacggccaacttcgcaccattatgcttcaccggttgatccgcattaacaaccaccaccttcaaagaagacggcccaccagcttgtgttgcatccagcaactgaaacaaaccaaaagcaacaccggctggcacaacgactgccaacccagcaatcgtcatgtagcgtgtcttgctactcatcttatcgaataacattacagttattctcctcctaaactcgaaacacccaatggcccttatcatcgggcaaaattagttaacagtagttaataattgcatagtgttaacaaataagtaagggcgttaacaaatgaacactatagcatggtttgtttaactttggaatagtaagtaaaaaataagcgtccgaactttattgttcagacgcttattgttaataacaaattatattaaactgacttgatgtagttcacaccatcagcggctggggcctttgacttagcaaagaacacaaccaagattagtaccgtaaagacgtaaggtgcaacttgtaggtaaaccgatggtacttggttcaagactggcagttgtgccccaacgatggccattgattgtgagaaaccaaagaacaacgctgccgccatggcaccaactgggttccaacgaccaaaaatcatagcggccattgacatgaatccttgtccaacaattgttgaagctgagaagttaccggcgattgattgtgcgaacaacgcaccaccaattccaccaagcacaccagaaatcaaaacgcctgtgtaacgcaaggcgtaaacattcaatcccaacgtatcagcagcttgtgggttttcaccaacggaacgcaaacgcaatccgaaacgtgtcttaaacaaaacccatgatgcaacaaaggcaataatgattgcaacccaggccgttgaagacgtcttcgtaaagaagatcgttccaataactggaatctttgacaagactggcacgttccagtaaccaaagttttcagcaatcattgatgtttgacccttaccgtacatcaacttgatcaagtaaacacccaaagctggcgccatcaagttcataactgtacctgacacgatgtggtcggcacgcaacgtcaccgttgcaaccgcgtgcaacaatgagaaaatcaacccaataaccgctccagctagcaaaccaagccatggcgtcaaaccaccaaattgaccagcgaacgtcaagttaaagacaacaccggcgaaggctcccataatcatggttccttccaatccaacgttaacaacaccggcacgttctgagaacgtaccacccaatgcagtgaaaatcaaaggcgctgagtaaaccaacgtacttgaaatcaccaattgcaagatcgtttccaaactcatgattactctgcctcctctactgtcttctcaggttccttaggacccttcatcttcttggctttttgctttgcatcgtcttcgtcaatcttaaccaagatcaaacgaatcaagtagttagcaccaataaagaagatgattgaggccgttacaacagaaaccaattcagttggcacacctgaggccaatggcattcccaaaccaccaactgacaaaattgagaacaacaaagcggcaaagaagattcctaggaatgatcctgatgccaacaaagcaacggccataccatcgtaaccaacttgtggggcagctgtttgagagaagatgtttaggtacgttcccaaaccttctgttgcaccagccaaaccagccaacaaacctgaaatcgtcatggccgtcacagccgtacgcttagctgacataccagcgtagcgcgctgcgtctgggttcaacccaacggcacgaatttcaaaaccaagcgtcgtgcgcttcatgatgaaccaaacggctaccaacgcaacaatggcgatgatgaagccgatgttcaaacgtgaaccacccgtcaagtttgacaagaagtcccaacgcaatgaatcgctggcgtgcaaggtgttcgtcatatcagttgtcgccatcaacttctttggcaatccttgcacaaaggcatttccaccatacaaagcgatgtagttcaacatgattgttgtgataacttctgacgcaccgaattgggcacgcaaccaaccaggcaaagcacccatcaaagcacccgcaagtgctccgatgataacagccaacggaattgacaaccaaggcgtcattgattggttaaccaagacgaaccatgttgaagcaatccacccaacccaaacttgaccagcaagtccgatgttgaagaatccagctgattgggcaaccaagaatccagcagccgtcaaaatcaacggcgtcattgaacgaagcacttcaccaatgttcaatgatgagcccaacgctgattgcaccaagctaatgtaaccagtaacagggttaaatcctgataccaacatgatgatcgcaccgaccatcaatccaaagaagacagccaagcctgctacgagacctgtgccgtatgaattaatcttattcaccagtctactcccccgctaattgcgcacgcgcttctgccaatgacataccggccatcaacaaaccaagctcgttctttgacgtctcgtttgcattaacgacaccagtaatctcaccgtgtgagataacagcaatacggtcagcgacgttcaaaatttcatccaattcgaaacttaccaacataacagccttacctgcatcacgttgattgatcaattgttggtgaatatattcaattgcaccaacgtccagtccacgcgttggttgcgcagcaatcacaaagtcggcatcacggtccaactcacgcgcgataatcgccttttgttggttaccaccagacaaagcacttgccggtaccaattcgttaactgtacgaacgtcgaacttctcaatcaattcacgggcgtgtgagttgatttgctcatagtccaatacgccagcctttgacattggggccttgtagtatgtttgcaaagcaatattctcagccaacgtcatatccaattccaacccaaagcggtgacgatcttcaggaatgtgaccaacacctgattcagtaatttgacgtggcttcttgttcgtgatgtccttgcccttcaacgtgaccttacctgatgcagttggcatcaaaccagtcaacgctgagatgaattctgattgaccattaccgtcaattccggcaatacccacgacttcaccagcacggaaatccaagctcaagttcttcacaacttcaacaccgcgagcgtccttaaccgtcaaatccgacacagacaaaactgtgtcagttgggtgagcaggctccttttcggtagagaatagtgaaactgaacgaccaaccatgatgtcagccaattcttgtgatgacacgcccgcaactgggaatgagtcaattgattgtccacgacggataaccgttacttgatcagcaaccgccttgatttcatcaagcttgtgcgtaatcaagatgactgacttaccttcagctgccaagcccttcaaaatcgtcatcaattcatcgatttcttgcggcgtcaaaacggcggttggctcatcgaaaatcaagatatcagcaccacggtacaacgtcttcaaaatttcaacacgttgttgcataccgactgagatgtcaccagccaatgcatttggatcaacatctaaaccgtattgttctgacaacttcttaatatcagccgctgccgtcttcgtatccaacttcacaccattaacgggttctgaacccaagatgatgttttctgtaactgtaaacgcatcaatcaacataaagtgttggtgcaccattccgatacccaactctgcagcctttgatgggctatcaacaattaccttttcaccgttgatcaagatgtcaccagccgttggttgcaacaagccagacaattgattcatcaacgttgactttccggcaccgttttctcccaacaacgcgtgaatttgcccgcgcttgacttgcaaattaatgtggtcgttcgcacggaactcaccaaattgcttcacaatatcgcgcatttcaagcacaattggctcttctgccatagtcatttctccctagaagctttcttcattcacaaaggtttcttatttgtgaaacaatatgtttattttacctattttttactaaattatccactatttgagaggctattattcgtctattaacatgcctgtaatactatttcgagataagttcatggttgtaaaaagaaaaacaggaactttctttcgaaagcccctgttttaattcgtcttttaaacgttttacttcatagtgcttggtacagtaacttcgcctgacttgatagcttcttcagccttctcgacagctgccttttcttcggcatccaagttcttcttagtgatagcaacaccgccatccttcaaaccgtaaaccaccgtcttgccgcctgggaattcacccttcattgattggttagcaaccttaacgattgagctagcaatttccttgatagctgacgtcaacgtgaagttgtccgacttgccatccttagtcttgtagttaccttggtcgttttggtccatgtcaacgccgataacccaagccttgtcctttgatccaaagtctaggtccgtgttgatgtccttagcagctgtaaacacagcgtttccggcaggtccagcagcttggaagataacgtgcgcacctgatgtgtagatggcgctagcaatcgtcttagcctttgccgtatccgtaaatgactcaacgaattgtgcatcaaccgtcatgttagggtcaactgacttaacaccagcgatgtatccagcctcgaatgattggataacaactgagttcataccaccgatgaagccaacctttgagtcacccaattccttagccttcgtcgctgcggcaacaccagccaagtatgatgcttcttgttgcttgtaagtcaatgaggcaacgttcttgtattgcttcttagcaacatcgtcaatcaaaacgtaatccgtctttgggttttgcttggcagatgcaaccaacgcgtcgttcgttgcgtaaccaacaccgatcaacatgttgtaaccagcagatacaccttgttggaagttcgttgcgaagtcagcgttcgtctttgatgcaaagtagtcgtaaccattcttacccttttgaaggtcgtgtgactttccccactcgcttacaccgttccaagcagactcgttaaatgacttgtcatcaacaccaccaacgtcagtcaccattgcgactgaaaagttcttctttgaatctgagttgttgttgttcattgcggcgataccaacaccagctgcaacgacaaccacaacaccaccgataatcaagttacgacgtgaaaccatgtctcatttcctccaaaagtacgatttgtactgttcctagtaattcccatgtctagttaacaaatgtttttcttgttaacctgacttgccttgattagtatataaggttcgcttaataaaaacaatgaagaaagtgtgaatttcgttcgtttaactcgttttttgttaaacgttttactggttttaagacattttataacgtaaaacacgaacaaaaataacgattttagtcacattgtttttggtaaaaacgttttacttggttttgataacctggttaaactccttattttcgtcacgcttttttctttacaaaatagttacaaaacaaaagggccgagttaactcggcccttcactatctactattagaaattttggtcaaactcagatccttcagggtggttaggcaccttgatatcaccagcgataacggccttctttgccttagcaacagcggccttctcgtcggctgacatgtacttagtaggcgccgcaacgccaccttccttcaaaccataagcaacaactgttccgcctgggaagttacccttcatcgccttgttagcaactagctcaagaccacgtccaacaccagtaattgatgacgttaacgtgaagttagactttttaccatctttgtccttgtaagcgcccatgtctgattggtccatatcaacaccgatgacccaaaccttatcctttgaatcagccgtcatcgtttggttattgtccttcgctgcagtgaaaacaccgttaccaacagttccagcggcttggaaaattaccttctcgcccttagccatcatcgccttggcaatcgtttgtcccttagcggcatccgtaaatgaatccgcatattgcacatcaacgttcatgttcggatcaactgacttcacaccagccgtataaccagcttcgaaggcatcgatgatgttaccgtgcataccaccaatgaaaccaacagatgagccaccaagatccttcgtcttagttgcggctgcgacaccggccaaatatgatgactgttctgaacggaacatcaatgagacaacgttcttcgtcttcttcgtatcaacatcgtcaaccaacacaaactcagtctttgggttcttcttggccgcattaatcgtcgcatcatgcaatgcgtacccaataccagctaccaaatcgtacttaccattaattgcttgctggaagtttggtgcaaaatcagcttgggtgtcggattggaaatagttgtagccattttgacccttctcaagaccgtgtgactttccccacttttgaacaccttcccaagcagattggttaaatgacttatcatcaacaccaccaacatcagtaaccatcgctactgtaaaattcttttttgcatcatcgctcttattaccaataaccgaaaatgctgcaattcctgcaactgcaacgacggcaatgccacccgcaatcatcaatcgacgtgagaccatgtttatattacccctcaaatttgaatcatcttgttttacgaccaaccgtcgtaaaaccacttgctatataatacgaacttcgcctagataaatcaaccactatttttcgtgtttagctcgcaataaaccatcgacttacgtattatcaattaaaaataagtctatttacgaacttaaatcgcgtttttaaaccgaacgtcagcaaaaagccgttttattcgattaacgaagttgttcaccttgcaaaatagcgaacataataaatgaccaagttttttcaaaaaaactcggccatttcattcaccattatttagaattgttgattgaatttcgaaccagcagggtggttaggcaccttgattttacctgacacgatatcatccttcgccttttcaaccgcggtcttctcatcgttggtcatattcttagttggtgttgccacaccgccttccttcaaaccataagcaactgttttaccacctgggaattcacccttcatcgccttattggccaccaactcaagtccacgtccaacgccagtaattgacgacgttaacgtgaagttagactttttaccgtcctttgatgtataagcgcccatatctgattgatccatgtcgacaccgattacccagaccttatcctttgaatcggcaactagttgttgattagtatccttagctgacgtgaagacaccgtttccaacggcaccagcagcttggaaaatcaccttctcacccttagcaatcatggcgttcgtaattgtctgccccttagatgcatcagtaaatgagtcagcgtattgcacatcaaccttaatgttcttatcgaccgattgcacaccggcaacataccccgcttcaaaggcatcaacaatgttaccgtgcattccaccaacaaaaccaacagtattcgaacctaaatccttcgccttcgtcgccgcagcaactcccgccaagtatgatgattgttctgatcggaacatcactgacgccacattcttcgtcttcttcgtgtcgatgtcatccaccaacacaaagtccgtctttggattcttctttgccgcattcacagtcgcgtcgtgaagcgagtaaccaatccccgccaccatgctgtacttagccgtcacagcttgttggaaattcgttgcataatctgcttgcgtctttgattggaaataattataaccattcacacccttagttaacttgtgtgatttcccccacttttcaagaccttcccaagctgattggttgaatgacttatcatctacgccaccaacatcggtcacgattgcgaccgtgtaattcttcttcgcattcccggcatcgtttcctgacatcgcatatgcagcgcccccaacgactgcaaccgccacaacaccaccaactaacaacaatcgacgtgataccatttcaacgtcctcccaaaataacattctgttgtatatacctctaaaaatgtaacatttcgttacgttccccgtatttactcagactataatacgcactccgctaacaaaaagcaagcgccacaattacgatttattcgtaataaatccaatcagcctggcacaagcacctggtattgctacgtttatcaaataattgcgaactttatttatgttttcactttaaataatacgcaataattcagaactaacattctgttatgagcgcacaaaaaaacagcctccgaagaagctgtttccagttatttattattgaaagccgttaagctcgtcatccccatccgtaactttcttcgttacttcttggccatgacggcgttgttattcagcgataacacccatttcacccaaacggttggcaactgagtatggcaagttaatctcagactcgaagtacgtgtccaagaatgccaattgatcaacagtcaaacctgatgaaacggcgtgtgataacgtcgtaataacttcggccgcagctggcgcgttcgttgcaatttgtgcaccgtacacaataccagtttcataatcataaattagggatgccaaaatatctgacttctcacccaaagcgtgaatcgttgctggtgtgtgaatatccaaacgttcaatcgtctcgccaattcgctccttggcggccgtaaccgtcaaaccagtcttatagaagaaacggtcaaacactgagaaaccaatagtacgcaagattggttggatttgaacatccacacctgccaatgcataaccagcaacacggcccatcttaagggctgcagacatcaatgggaagtattgatcgaacttcccatcaacaacggctgaatcaccgactgcataaatgtcaggatttgatgattgcatttggccattaacgacaatagccccattgtcacgcatatcaacttggccagccaacaacatcgtgtttggttgcaaaccagaagcaatggccataaagtcaaagacttctgaagtaccgttattgaagttaacttcaatcttcttaccttgattttcaactgaaacaacttcttggtgcttacgcaaaaccaccttgttgtcagtcaatgtcttttcaaggtcttcttgcacagtttggtcaaagtaacgtgtcatcaaacgctctgaacgcgtcacaaacgtcacgtgaacaccggcgtgaaccaacgcagcagccaattcagttgaaactggtccaccaccgtaaaccaacgccttcttacggaagcccttggcaaacttgttgatatcttgtgcgtcttgttcatccttaacaaacacaacacgatccaaatcagccccgacaaatgaaggtacacgcgctgatgaacccaatgcgtaaaccaacttgtcaaaactttcttcaatcatcgaaccatcttcaatgcgacgagcgtacacacgcttcttcgttgcatcaatacgttcaaccaagacaccggcacggtacgtcgtgtttggttgaccttcgaagtgctcgaagttaacttgctctgcgctacttaccttaccattcaatgctagcttgataccagctgaaataaatggacgatcacgcaaattcttctctagaatgacaatttcatcatccttattaacatgacggaatgcgttcaccgcagataaacctgcgtgtgcaccaccaataaccacaattttcatattaactaccctattagtatctatattttaaaccactattaacgcgtttaggcacgtagcttttcagggaaagatgccccaaaaacacggtaccattcagatgcaaacaatgattggcgacgagtgcgcttcaacatcatttctgtattcaaacgtcgttcaatctcaacccacgtgatttctggttcagtcataaccatttcacgggcatccgccaacaagtttttatcaacaaacttcgcatccaaagccacatcatccaaaaatggtgctgatagcaatgatctaatttccatatccatacgcttaatttgcgcgtccatcggttgcaaacgcttctgcacccatctacgcttcgagaacaagtctcgattcaagactgaatagtaaatcaataagtacaaagttataaaaaaagctaatgccgtagcaccaacgtaaatgataatcttatcaatcggcaagattggtaatccaaagaatgcaagaactgccgccaaagcagttagtacaaacgaaaggataaacgtcatcgtatttttgagctgtcctaatcggacacgtcgctcagcacgaagtcgacgtcgacgggatgataaacgggttaacgtgtcgtttaattgtcgcaaatgttccaataaaacgagcttgtcgtccttatccatatgactcaatatcctattctctaaaaaattaaccttacgaggactagtatatcccgattaaaattaaaaaaccacgaaaaagcccgctttcgcttacaaaaaatacgcttcactataatacgacaaagtacgttaaaataatagtatggagttatcaaaagaaattcttgtccaagaacaagaagcattaaagattgccaagcttctggcgaacgatttgcgtttgcaaattctttgcctactgcaagaaaatggcgcagctactgttaccgagatcatgaacgcgttgcatgcagaacaatctcgcgtttctcaccaactatctgagttacgtgaataccagatgatttctgccactcgctcaggtcgccaaattacatacgcccttaccgatccacacatgatggaattgcttaacgacttgcttgaacacgcaaaccacgtgcgcttgcatcgcgagcacggcggcatctaaaaaaacgtgacgaatccgttacgtttttttagtttaattgcgtataatgaaatcaatatacttctaaggagttctcatgaaagaatttaaaagctttattctccgtgaagacgtgcaaaagttcatcgctcttggcgtcattgttctaatcatcgccttgctacatgacttgattagcgtcctgttgctaacggctatcattggttacttggccgttaaagctgctaatcgtgtttcacgtttgacgaaaattccctatggcttttccgtcttaatcgtctacttattagcgattttcgtatttgtgttcgccatgatttacatcgtgccaactttgattaatcaattcgcggtcattccagacgaaattatgaagctcatcaaaaagtatcctgttattaaggaatacttcgatgatacgtataagaagctcaacctgcttagtgaaattactgacaactggaagtcactcttggctagtggtatcaatacgatttcaacagtgggtactgtcctatctcgtatcgttttgtcaatcttcatgagtttcgtacttgcgattacttggcaacgccttcgcattttcgggacccaattcttgcactccgattatcctaagttcttcaagcgcatttacgaccttggtcgtacattcattttgattttgggtagtgtcattgaagtgcaattgattatcgcctttatcaacaccattttgatgatgattggtttgagcattcttggtgtaccgagtatcatggtaatgggattgatgattttcatccttggtttgattccgattgccggtgtcatcatttcattgttcccattgagcgtgatgtcatttgccgcccttggttgggttggtatggttgaggtttggattatgattgcgttgattcacatgttcgaatcatacttccttcacccacgtttgatggccagccgtactgagctacctgttttcctaacgtttgcaacgattatcgtgatggaacacttgctcggtgcctggggcttgattattggtgtgccgattgtcgccttcatcctcgctattctaggcgtacaagatgcaagcatcagcaagcacgtcaaagataataaggtcgtcgctgaaaaagattaaaacacgcaaaaacgctagtgaactgattagttcactagcgtttttctgtatctgtttaaattccaaatgtgccaccatgcacttcagtgacattcgtcgtgacaataaaggcatcctgatcgatatcgtgaatcaagcgcaacatgtgtccatagttggcgttgtccaccataaccattagcatttccttgttattgtcagtgaagccacctctcacatcaaaaacggtcaagctatgatcttcgctgagcaacatttcttgtatgtcagctagcttgtcgttactcatgattgtgacttgatgcttcaaatctagtcccgtttcaatgtagcgcatcaccattgatgtaatcaccaacgagaacgcggctaagaagaaagcattcgtaccagaaacaaacaagttaaacactgtgaccaccatatcgatggctaacaaagaaatggccgtattaattttaaaatactttttcaagatcattggcggtacagttgtcccgccacttgatgcttcaaagcgatataaaatggcaattcctgaagcaaacactgccccaccaataatcacggcaaggacggcatcttcaacgactttatgacttggtgtaatgtacattaataccggtaataaaaaactaccaaaggctatattgcgcaccgttgaacggtccaagaatatcgctgccagaataatcatggcgatattaataattagcaccgtcaaagcacggttaatgccaaacgctgcatccagcaaaatagcgacaccggttgcgccaccagcggcaacgttaatcggtgcatagaaaaagttaatcgaaagcgcgataatttccagcgctactacaagagatagcgctcgaaaccagccctgttgactcaatcgtttgttcatatgggtctccttatgggttggaaaggtatttaagttatatatctagcataacattttcgcgctattgatgtgtgccatttttttaaacactacttggtttcttcaaaccattcgtcaattaaacgctcacgcaacgggataaaaagttcgccagctttttgtccagcggcctgtccatcaatcgaaacaacgcgaccagcaaataacaatgaactcgtgatgaacacctcatctgcggtcaaaagttcctctttggtaaaggcacgctcttcaactggcatccccaaatcacgggctgcttggagcaagtgaacgcgagcaatcccaggtaaaatcaacttgtcggtcggcgccgttaccaacttaccatccttaatcatgtgcacattggtatgcgatccctcggtaacccgcgttgagccatctgcgcagatacgatagtagactgtttcatccacccccgcttcagctgctcgttgtgccgataggacattgggtaacaagttcagcgttttcacgtgtgccatgtatgagcgaatgtcttcttcggtttgaatacggaagtcgcgagtttgtgcctcacgggtcaccgtcatcggcgtaattgtcacgaataaattaggtttcgcatctttcggaaatgaatgatgacgctcaccactaccacgggtcacttgccagtaaaccatgtaggtctcgttcgacactttgctagataaacgattgagcaaagtcgccaattcatctttggtgaaatctggcgtaatcataactgcatccatactgcgccaaaaacgatccagatgttcatctaacgcaaacagcttatgatgacgtacgactgttgcatcatacaccccatccccaaagtaatacccgcggtcggttgctggaatcatcatatcttccagtagcgactccttgccgttgtaataggcaatattattcattttcaacacccccgcaatactttctaatcatttactcataatagcactattttaaggcaaaaaaacacccgaactgaaaaagtttcgggtgttaattcgcttcattgtttcttttgtaacttaacggctgttccatacgccgcaaccatattcatgtcagcgcccattgagccagaatcaaaacgcatcatcacgaccgcgtcggcgcccatcttagcggcattctcacgcaaacgctccaacgaagaatttcgcgtctcttccaacaacgatgtgtatgccttgatttcgccaccaacaatcgtcttcaggccagccccaatatcagccacgacattctttgatcgcgtcgtcaatccaaacacttcgcctagcgtttccacgacttcataaccggcaacgttttctgtcgttgccacaattacgtcttttgcatttgccattagatacccccctgacatacttaccttcaatatactcggaaccattccaaatgcaaataaaagacactatcaacatcactgtcgatagtgtctttcaaatggttgattagtcttctgacttcaaaaccttctttgatacaactgacaagtcatctgccaagtcgtataccaaaggctcaccgttagcaatctcaacacccaagatgtcatcatctgagatgttttcgatgtgcttaaccaatgcgcgcaatgagttaccgtgggctgcgataacaacgttcttaccagccttcaaatcttgtgaaatgttagactcccagaatggcaatacgcgttccaacgtaaccttcaagttttcaccgaatggcaactcaccttcaggaacatcagcgtaacgacggtcaaaggctgggtaagtcttacccaaaacttcaacagtctcttcttgcgtctctagcaatggaggcaaaacgtcgtatgaacgacgccattgcaaaacttggtctgctccccacttttcagcggcatcagccttgttcaaaccttgcaaagcaccgtagtgacgctcgttcaagcgccatgacttcatttcagggatccacaattgaccagcttcttccaaagcgtagtgcaacgtcgtgatcgcacgcgtcaaaactgacgtgtaagcttggtcgaattggatgccttccttggccaacaattcacctgcagtacgagcttgggcaatacccttgtcgctcaacttcgtgtctacccaaccattgaacaagttcaatgcgttccattcactttgaccgtgacggatcaaaaccaactttgccattggtgatacctcttttgtattagaatatttcgttactattgtaacaaaatttcacaataaatagtagtgattaattgttccccaaagtttcaccggtaacatttcgcctaagacgacaacagaggtaccgcaacgaaatgcgatacctctgtcaaaatgtgttatttaagttaaatcgagcatatcggaacgactaactgattacaagcaattatcgcttgatctcaccgttctcgataaccaaaccagatgagtgaactggtccttggcgatctgggtagatgcgcttgatgatactgttaacagccgttggcacttcaccaaaaccagtggcaatcaattcagccttacctgggtactcagccacgtcaccaaccgcgaagacaccgggaacagtcgtctccatctcttggctaaccgtgaacttctgacgctcaacggctggttgaatcgtccaaccggcaacaatcttattttcggacgtgaagccgtagttaaccatcaaatcatcaacgttcaacaccttcttttcatcttcacggaccttagccaaagtcacgctcaatgaaccgtcttcatccttttcgactgactcgatgttgtaaggcgtctcgatttgaacggctgacttttgcaattctgaaacagcgtgttccatggcacggaacttgtcacggcggtgcgtcaagtgcacttcagctgccaccgtgtccaacaacgttgacatatcaacagctgaatcaccaccaccagcaaccaaaacacggtggtcacggaagtcttcaacgtcgttcaagaagtagtgaatcccttgaccctctaggccgttttcaacgtcttcaggcaaacgacgtggctcaaaagcacccttacccgttgccacgataactgacttagagtggaatgaccccttatcagtcgtgatatcaaactcagtgccgtttgggacaacatcaataactgtcgtatcaagatacaaatcttgttggaattgacgcatttgatcatcaagttccttcacaatcttggctcccgttgtgttcacataaccagcaatatccaaaattgtcttttgtgggtaaaggttagcgacttggccaccaacactttccaaactttcgataatcgttacgtctagctcacgcaaacctgcgtaaaatgcagcgaacataccaactggccctgcaccaataattgttaaatctgtatccttaaattcagtcatgattgtttacttcccgtttctatcggattttatttttctcttatttactttttgtattatacgctacaaaaaaatccgctgcataggataaaggaccatacagcgggttattcttacaaattacggtcgtacaacgttgtgaattctgacaaatcaacgccgaagtcgtttgctgaaacaatatcaacagcgtttccttcttcgccagccttctcttcgaaaatctttgcgatgtcagcgtacaaagcttggtaagcttccttgtcaggtccatcaacaaccaacaagtagttctccgtaccagttgcttcgttcgtcaaccacaacaagtgcatacgctcaatcttccccatggcgtcatcagccaatccaatcaagtcgtagcgcaatggcgttggaataacatcttcagcagaagaaatttgcatctcgccttcaccttgttgtgctgccaataaacctgcaatgtaagccaagttttcacgtgaaattggcataccattcgtaaatgggttcaatgccaatccttcaagattttcagagtcttcgttttgcaaaactggcaagtagtcagtcaatgccatcgcccatgggtgaacaggctcttctgaatcaattggttgggcgttgaaagcatccaaatccgtaaagattgggaatactgagtggccgttttccatctcaaaagtcaacaaacgcatttctgcgccttcagggatttcaacatctccatcttccttaatgattggtggctcactaaagttaactggtgcaataaagactgcttcaatcaacgcttgaataaacgcttgctccgttgtgccattttgatcttcgcgaaatgctgccaacgcatctagcaacgcgtcgttacgcaaaacatcttcttggttatccattatatttccccattcttaattccttgtgttctatctagtataacgaaaaaaagagcacctgcccagatgacagatgctcaatgtattagattactttgtgtagattggtgcgaatgcagcggcacgtgggtaaccaatttcttgaacacccaatacgttcgtaaatgctggggcaccagccatttgagcaaaggcaaagaattgtgccttcgcttcttcaagctcaccatccgtgtggataacgtaaatcaaagcgcgctctggtgcacgaaccaagtcgattacccaaaccgtttgcaagtcaggcaaaacttcacccataccctcagccaacttggctgcgaactctgtttgatcatcaactggatcttccaacgtaattgggtcttgctcacgcatttgcgtcaacgttgccatcacgtagttcatgttgtcttggttcatgacaacgttttgaccgtaggcattgataaccaaaccagtatcagggttagctgacatcaaagcagcgtaagtttccaatgaaacagtcaacgcaacaacgccttcagcttcagttgaccacttgttgtactcttccgtactcgtgaaaactgggaagaatacttcaccctttgagttttggatgacttggtagttcaattgtgcggcaacttctgagtcgattacgaaagtaccatcaccgttgtcagtcaattcagcatcaacttgtactggtgctagcaatgatgcggcacccaacattgcgatgaaatcatgctcagtttcagggttaacatctttctcgtaagcatctagcgttgcttcaagatcttcattttctagtggacggttgaaaatcacatctgccatggtcaaattcctcattcgtttattttttgttagtataccccaactaaaacgaatcgtgttgtaaaaaggtcctgaccgaaacaacctaatctaatgtttcaggtacgacgacttgcttgtccaaaatggccgtcttcgcgtcctgcacagccatccaggcttctgtactcatacgaccacgtgtcaccgacacaccatcattagcaatgaccatacaccaggtgctcaccaccagggaatttgtccttcatcgccaagttagcaatatcatatacaacctgatccattcgctttaacactgatgtcaaagtgaaatttgatgatgcatctaaagcctgataacgaccgctttgtgattgattagtatcaacaccaatcacccaaactttatccgcactacggcgtttttcattgattgagcgtgctgcttcgaaaacaccttgaccggcaccaccagccgtttgatagacgacgtcagcccctgcttgatacatattgttcgctaatgttttggcggttgcgtcgtttttaaagtcgccaacatagtcatgcaaaatttgaatatcggggttaattgactttgcccctgcaatgtagccagcttcaaacgcttccatgacaactgacttttcaccgctaacaagaccaatcgtgttagtcttcgtcgtcttagctgctgcaacgcccgctaagtaagatgattgattggcttgaaaggtaaccgaggcaacatttggtcgcgtctgagcaacatctccaaccatcacaaaatcacgatcagggtatttttggactgcttcgtccacagcatttatcttgcgatagccaaccgcaaaaatcgtcttaaagccatcattcaccgcatctgaaattgctgagcgcgcttccgtcgcggttaccgcgtgaaaggactgatacccatcgattccttcagccaagccagtttctagcgcgtactttttaacacctcgccaagcgagctcttggtaagattggtcatcaactccggccccatccgtgatcattgccacggttgcctgaattggttctgtttgcgcctccgttgggcgactcgtcatcatcattccggcaaccactgcaattagcgtcgttgccgcaacaccaataatcaaatttcttttcatctctttccctcaacatgaaaccaaattaaaagacgttgtgcgtaaaatgcacaacgtctcatttaaccaaattactttgaaggaactgtgatttccttatcaacaatcttcttttgagctgcttggacagcttgccaagcttcatcagacatgtttccgcgtgttacagcaacacccttgtcatccaaaccgtaaaccaattgcttaccaccagggaacttatccttggctgccatttcagtcacgtcaacaacggccttaccaaccttcttaactgatgatgtcaacgtgaagtttgacttaccatccttagccgtgtaggcaccgtcatcgttttggtcacggtcaacaccgattacccaaaccttgtcagcagcgttcttttcgctgttcaagtccttggcttcagtgaagacaccagcaccggcaccaccggcagctgagaagataacatcagtaccgttttggtacattgaagcggcaattgtcttacccttaccggcatcagtaaagctaccaacgtattgtacatcaacttgaatgtcagggttaactgactttgcaccagcaacgaaaccagcttcgaacgtcttcacaaccgctgactccataccaccaacgaaaccaagcttgtttgtcttagtcgtcttagcggcagcaacaccagccaagtatgatgattgttctgacttaaacgttactgagacaacgttgtcacgcttctttgcgatgtcatcgacaatcataaagttagtgtctgggtgcttctttgcctcttcgttaaccgttgaagtcaattggaacccaataccataaatgttcttgaaaccggctgacacagcttgatcataattcgtcttaaaatcagcgtgtgactttgattgatagtaagtgtaaccattcttaccttgcttaacgccgttttccttaccccatttctccaagccttcccaggcagattgttggaatgacttatcgtcaactccaccaccgtcagtcaccaatgcgactgatgtcttacctgcttcacctgaagctgacttgtttccagatagtgcggcgtatgcgccaccagcgattactactactgcagcaccagcaatccacatctttacgtttgaagccatgttgttttttcccctttatgaaaaacccatttattttttcgatgaccaattcatctacgccataaatataacgaacaaattcataaaagtaaacgattatattcgcttattcacaatttattcacagttaatcgttttaaaaagttctgaaatacaaggtaaaacgtttataacgcgaacgttacttgttttgtcgcacaaaaaaagcgacgatttccgtcgctcaatcagttttttattaatttaccagtcgaaccatgtacgtttctggcacaaaaccacggacagcattgtacaaacgtttagctcgtgacgccttatcagtaattgcaaagaccgtcggacccgtaccagacatctgcaccgcatccgccccgaacttacgcatcttctcttttagctttacgatttctggatactttgacgctgtaactggttcaagcacattaaacatccccttgaacgcagcatcaaagtcaccgcgttcaacggcgtccatcaacgctgacatatcaccgtgttccaagttgtcataatcaatcatcttcaaaattttaggcgtcgaaacactaatcgccggctttgatacaaccagccatagcggtggaaacttttgcgtaagtggtgccacaatttcaccgcgccccgtcacccgtgctggtcgtgagtaaacacagaacggcacatcggcatcaatcttcaatccaatttcagcaagttgcgcttccgttaacgtcatatgccaaattttatttaaaccgcgcaatacggccgctgcatccgatgatccaccgccaagtccagctgccactggaatatgcttgtcgatatgaatttccaccccttcagatacacccgcccgttcgcgcattaattcagccgcctgataggctaaattcttttcattcaatggcaacaagccacttgtcgattcaacgataatctcttgatgatctgtcgttgttcgaattgtgactgtgtcagccaaatcaatcgcaaccatcaacatgtcccattcttgttcgccatcagcatgcgcaaatggcgtatcaagactaatattaagcttcgcatatgcgcgttctaaaatttccatgttaacggtcatcctttcgcagagtttctttcattatagcaatttgcaaccgtttacgaaacaatcgaccttgcttgaaaaaagccccatttatcggacatctcctgtatacttaaagaactatacaacgaaaggttgctcatatgcgctatctctacattttgctcgggttgatcacgttcggtattggaaccgtaacgatttgggtgcccggcattccgacgacgcccttttacttgctaactgcatttttctggggtcgttcatcagagcgacttcacgcctggttaacccaaaacaaacactatcaaaaatatgtgcacgaaggaatctaccaccgcggtttgactcaacgtgcacgcatcgtcatatatcttgtgaccgcagctatgatgagtattccattcttcacttctggcaagacatggctacaattcactttgattggcgcatcactcagccaaattatttcgatggaaggtttctaccgtggctggtggatgaacaactggttcctacctaaggatgacgctgaataaaataaaacctcgacttttcagtcgaggtttttttcttacatatcaaagcgacccttaagtgatgcaatcacgtccggtgtcaatctaacactgttggcttgaatgaattgttgcacatctgcaaacgtctcaaacttttgcttaacaggttgtaccaagttagcttgcaacaacgcttcggcaaattgcacatcagccatgttaatcgttgtcattccccaaggttgtgacaacagcaattcttcccacgcgcccttaatcagtgcctcggcacgctcgtaacgacggtccttgttaataaacgaccgcaaatcaactggattcaaatcattctctgccatcatgccactcctctaaccaactggcagcatcatcgcctaaccattgttggtttgtttcaataaaatctttaaagttatccgcgacatcagcttgctcaactaagtcagcttcatacagcgcaatcgcaaattgcgcatcagtcgcagcaatcgtcgtcggtgaaattggatgactcaccacgaagcgattccactcattccacaacaaagcaactgcgcgttcgtattgtggtgcccgcaaaatcacggcacgtaacatcaatggatcaagcgccattaatttccctcccattttgttaatgtcacaacttggcctaccggttgcaaaactgaaagtgtcgcgtcagttggcaaaacccacactaatcgacgataacgattagctggcaattcttgttcaccgtcaccatcggtaaagataaccacgacagtactctgcggttggtagcgctctgactgcaacgtttcaaaaatcgtcgcaaagcgcgtgccaccaccagcacgacggcgaccatcggcaatccaattcttatcgattgcatgcacctcggtgtcaaaggcaaagaaatccaccgcagccgcaagttgcttttgcatctgggccacttcagcgataaagcgactcgccgtgtcatctgaaattgaagccgaattatcgataaagaccgctatcttagtttgcgtggcatcaacttgcccaggtaattccatgcggtacggttgacgtcgattgaaacgggcacgactatcttgcttgccggctggtacattactcatcgccttacgcaacaagccacgccagttacgtcgtggcgccagcagttgttcaatctgacgttcaacctcaccggccatgttaccgcgacctgcaacaagtgcatcatggttggcatcggcaacgacgtttcgcaatgctgcctctgcctcttcgccagcttcagcgcctgtcgaccagcctttgtgatcatcccccggcaactgtgaactagccccttcgttatcaatcgtatccatcaatggatgcaatagattgtaataggtacttgaatcggcatacgtcggcaaatctaattcaatcatttcctcaacttcagctagcgtatgcgcgcccggaaaaccaccacgaatatactggttcactgacaaatccgttgctagtccaaccatcttagcctcggctgcgttttcagcaattttatctgcataacgaatcggatgctcccacaccatgtgtagcacttggtgggtcagtgcacctttgacatccgcaactgagtgataaacttcttcgaataaaatcggattaatgcgcaactcccagaatggcgcttgccaagaaagtcccatcgtaccgccgacagtatcatcatacacacgatttaatcttaggacgacctcgccataaaaacgactttcgtccaacaatttcatcgtggctttttgaattaattcatcaatcttctgataggtcatatgcggccacctttgtgatgacatcgtaaagttccttcgcgtggtcaccagtcgaactatagagttgctccaacaagttacccgctgctaattgcttaacgactgcgtattgtccgtccttagccgttgctgtcaaaatttgcgtaaagcggccagcgttatcatcttgggcaatatcaatggcggctaacgttgacttcaacaaagccaacttttgtacctctggcaaactgacaaatttcgtcatcacttgttctggcacttctggtccccatggttggctgacaaagatatccattggcgtcaatgtttcttggtttgtttgcatgaattgcacgaaacgttgggcagcagcttcacccaggtcaccagccacaatatcaaaaaccaatgcttgttgggtcgcttcaggcaacgtcaacaattcatataaattatctgacacacgttgccaagcacgtggcgtaggattcaagtcatccccacgttcagctgggtaaagttgcgtcgtatcttcttgtaggtaacgttgaatcatctcatgaatgtttgggcgttgcttcgtcttatcttcagtcgctgcccaagcaagccagtcagcaacatcaaccttcatcaccaaacgaacggtacgatccttaatggctgcgtcaccggcgacaacaccgtaatctgcgttttcaaatccagccattgtttcatcgggattttcagcaattaccaacttcacttcatctggcaaacttaatgagttgatttgacgctgcaaaaccaaattcatcaactcactttgaacggcctgcgaaccacggttaaactcatccaagaaccaaataattggcttacctggatacgcttgtgcggtttcaataatctcaatcaacgtgtgcgtgtaaccgtacttcacgtcagctaatgaaccgtactgcgccgtttcaacgtaggcatcactggtcaaaggtggcactggaatagctaggtcacccttttctgacaaagaaacaaccgtcgtaaagagcgttgcgcccatttgacgggcaacttcagcaaccaacgctgacttaccaataccagcttcaccgacgatattaggcacattaccgcctcgcaacacgagtggaactgccgttactaattcctgaaatgaaagcgccatgtcgtttctcctcaatctactgttaattacttatagtttacgctgttttaaatcctttttggtggtaaaagtggtttgtgtcctccgcaacgcatcgacacaaacaaaataagaaaagccaccagatgctttaagttcatctggtggctaccatggtgtttcagttgtctttctgtacgcgacaatcgcttggcaaagtatcatgacatgagttaacaggttcgtccatctgtacacttcgttttccaagggaaggtctcatgtcgttgattcaataccaggttaagactagctcattgtttgcgcgtttgatatgagcgtcatcgtgacgattggcaatcgaagcatcaattcatttatgaattatacggaacacttttgcattcgcctaataaaaagggaactttacttcaaatacgctgtcgcaacatccttaaacaggtcgatcatcttgaagtaagccgcttcttcaacatactcatcagccttgtgcgccgttgcattacctggtccgatgaccgccaattgcatgtttgggttggccttgataaattgtgaggcatccgttcccaacgaaaccgcaatcgctggtgctgccattggttcatccaaatactttggaatcgtttgttgaatcaattgaatcaattcactgtcctttggcgctaccactgcgccatcgtacgccttcacattcaagcgcaaatccatttgtggatctgtcgccatcacatcagccattaactgtttcaaacgaccaatcaattcctcaggcggcagttccggaataatacgagttagcaccgttaacgttgcagagtcaggcactgagttttgttgttgtccaccttgaatcacatcgggtccgtatagcgtacggtccaacaccggactaatttctggcaagtccgcatagaattgcttttccgctagatagtaggtaatcaaatggtcaatcgcattgatacccaactttggcatcgaactgtgggctgccttccccttcgccgtcacttcataagctaaaaagcccttgtgcgcgtggaagataaagtgttgttcaggcgctttactaccacgcttcttttcattcaactcagccaaagcttccggatcaatgaccgctccaccgctgtgaaaataatcatcaatgtcgtccaacgccacgccagttggttcggcaatcaccatcgcttcaacatcatctaagtagcctcgctcagttagcaacttcgcgccagcttctgtcttctcttcatcaaccgtggcgatgaagcgaatcgtgccatgcaacggtgcaccagattcttgcagctcaatcatcgcaattaagaattcagcgataccgcccttcatatccgtcgtaccacggccatacaagcgaccgtcctttgtaaccacttcaaatggatctgttgaccaggtatccaaatcaccttcgtgaaccgtatcaatgtgaccagcaaaggccagcactggtccttcaccatccccaatttcggctacaatattagcacgctgtgaatcatcagccactagctgactttcgatgccgtggcgcttaaagacgtcctgcaaataaaccgctactgatgtttcattggctgctaccgtgttaatggcaaccaagtcttttagtattgttaatttttcttgttcccgcatagttttccccacctttaaaacttctcatgtaattttaatctatgtggcccaaatacgcaaaacagcgattaagtatcataagagatacttaatcgctgtgaacatttttactctattaacgttgttgtcgtgcctcaatctcagcaacgacttcttctggtttctttggatgaacgccaatattcattaagatggcaatcacagttccaatgaacgtatcaaacacacgttccacggcgtacatatacgtcgcatctgctggaatcgtcaaagcaatcatcagcaaagccgctgttgatccaatgattcctttattattaccaatgccatcgttgatcgaaatcagtagcattaagaaggtcggcaagaccagaatttgaacaaggctcgcctcgttgaagtactcataaatcaaaaagtaagcaatcgcaaagccaccacccaaagcgttggctaggacacgcgacttaccaaactcaaccgtcgtctcgaaatcctgtctgagcgaaaacacagctgaaagtgctgcaatcataggattaccacgatctatgaggacgaaaattgccacgataatcatgacagctaatcccgttttaaacgtgcgcatccccaatcgaaatgatcctaatttcatacagttgcttctccgttgttattcgtattgtgttgcatgacgataaccaataaagatcatcgttgcaacgccgacaaaggcaataaagacaacacctgctccgccatagaacaatgagccataaccgctctgttcaatcacggcaccacctagcaaaggcccaatggcacgaccaacggacggtgccgcggctgttagtccttggtaacgtcccttcaaccccattggcgttagctcattaaccagcgctggaatcattgggaaggccgttgcttcaccaattgttgtgacaaccatcgccaacgcaaagccagtgaaagtcttagcgaatggcaaaattaagaacgccaaaccaaacatcaacaagccggcgaaaatctgaatgaacattgatttgcgattagctgataagttcaaagcgttcataccaagttgaataacagcaatcaaaataccattaatcgtccacaacattgagtattgccacagaggtagcttcaacacactcgacatgtaaactgacaaattaccaagccattgtgaatacgaaatccacaacaccatcaaaccgatgacaccggtataaaccaagcgccaattccactttggtaatttgaaactcgactttgttgtcttttgttccgtacgttccactttaattttgaaatgtgaacgcacaatgaacaaaaggacaatatacataatcaaagctaagataaacaaccacgtaataccgtacgtatagataggtccaactgcagccgttgcaaataccataccaaagtttcccataaagtacagcatattaaagacaaatcggccgtcatggctccggacataagttccgtacgaattaatcgcagctgtgttccaaccaccgaagaacccaaccacggctaaaataaccgcataagttggccaaccgtggaaaagaatgaacaacacttgcaacacaatcatggccactgttccgaattgaatcagcttatgtggtgagaagcgatcaaataatcgaccactgaccagcgatccaaccgcctgacctacggcattggccatcatgacccacccgataatgactagtgtttgataaagttcatcgtgcaaatacactgacgtcaacggccaaataaagccaaaggcaacactgttaatgaaactagccgtcagtaaccagcgaattgacatgccttgttcgtttgtttgcatcccttacctccattattttgaaaaaagagaacgaggctaccaaaatggtacccccgttaatgactgttgttattacccgaatccacctggttcttcagcgtggaattcaatgtttgagaatttgttgtatgacttaacaaatagcaaacgggccgttccacgtgcaccagaacggttcttttccaagatgacttcgatttctccgacatcttgttgttcttcatcacgtggatcatttggattatctgaatcatcgttggccttctcataataatcatcacgatacaagaaagcaacgatgtcggcgtcctgctcgattgatccagattcacgaatgtctgatagcattggacgcttgtcttgacgttgttcaacactacgagaaagctgagaaagtgcaataatcggcacatccatttccatggccatcatcttgatggcacgagaaatagctgagacttcttgctgacggccttcgcttcccgttccttcaatcagctgcaagtaatcgataataaccaatccaatttggccttcacgcttgtatagacgacgcaacttcgaacgaatttccgtcaccttgatacccgctgtatcatcgatataaatcttggtgttcgccaatgaccccatagcaacggccaaggcattccattcctcggaatccaattgaccagtacgcatgtgctgtgagttgatgttcccttcagccgccaacatacggttaaccaatgacgtatccggcatttccagtgagaaaataacaactggcaagttcgggtcagccacggcaaccttttgggcaatattcaaaacgaacgccgtcttaccaacggccggacgcgcggccacgatgatcatttcgccaccgtggaacccagtcgtcaaattatccaaagctggataacctgaagcgagtcccgtaaccgtctcagttgttcgagagttttgctcaatttgctcaaatgacttctcaaccacgtccgcgatattcttaaagtcagcgctcttctcgccaccattaatcatatccagcttcgttgacaattcagccacggcatcgtcaaccgaatctgaaccttcatacgtttgcgtcaaactgttttgcaacgtatcaatcatgttgcgacgaatcgacttttcacgcacaatgcgcgcatagtacaacgcattaccagcaaccggcaccgttgatgctaattcagtcaggtaggccatgccacccacgttttcgacttgattatccttattcagttcatcggtaatcgtcaaaatatcgatggcacgttgcgtttcatcaagcttcaaaattgccgcatagattaaacggtgtgccgttcgataaaagtcagatggttccaagattgtcatcaagtccgcaatcaaatcctgcgggtcagtcgacaacaaaatagatcccaaaacggcttgttcagcggtcacatcttgtggcacgcttagcgcagtcgtttctgtttcatctgccatgggggcacctccttcatcttcttattcataaaatctattgtaacagaaaaagccagtgaaacatcactggctcgtcactttatttatccaccgatttttattgctcgtcagtgtggatacgaatctttgcctcaacatcgtggtgcaacttaaccgttacagtacggtagcccaacgcacggattggctccttcatgtccatcttacgcttatcaatcttcaagccgaattgcttttccaatgcttcaacaacttgctttgatgaaatagcaccgaacaagcgaccatcagttccggccttcgccttcaactcgacaaccgtcttatcgtcttccaactttgccttcaaagcttcagcttcagccttttcttcagcggcctcacgatcggctgccttcttttgaccacgcaatgcagaaacatttgcgttagttgcgggctcagccttcttgttcttaatcaagaagttgttagcgtagccatcaggaacttccttaacttcgcccttcttaccgcgccccttaacatcttccaagaaaataaccttcatgattatcgacctcacttattaatcttcattatcactatcatcatttgctcccgcaagaacagacaataattgttcatagacagcagtcgttgtcgtatctgaaacctgcgttgccgcattgctcaaatgaccgccaccgcccatcgcttccattactaattgtacattaaatgacccagttgagcgcgctgaaacggcaactgtattatcatcgcgtcgtgaaatcacaaatgaggcttcaatgccaatcatttgcaacaacgcatccgcagcctgagcggccacaactgaatcatattgcacatcatcttcaccaatgacaattgccgcattattatgaatttgcgcacgctcaatcaagtgggcacgctcacgatatgaatcaaccgtttccttcatgaagtcctgtagcatcttaccatcggcaccgactgaacgtaggtaactagccgcatcgaacgttcgcgtaccagaacgtaacgtaaatgacttcgtatcaacctggataccagccaacatggcagtcgcctcaatacgagacagtcccttcgtacgacgtggttgatactcgaacaactccgttaccaactctgatgttgatgacgcatatgactcgatgtaaaccaattgtggttcatcagggaactcctcgccacggcggtggtgatcaataatcacaactcgttcagagagttggtgataaacttccgtcgattctgaaatcgatggcttagaatgatccaccataaccaataagctacgttcagtcgcttctgacaacacttgtgacggtgccatcattgcagattgatctgacggatcagccttgagttcttgcaacaacagcttaatgtctgagtgttcttgactggtttcttcatagacaacccaagatggcttgcctagcatctgtgccaaacgacgtacaccaagcgctgcaccaaacgaatccatatcagaacgcttgtgtcccataatgaaaatttggtccgcttgcgtcatcaagtcggccaacgcttgcgaaatcacgcgcgcacgaacacgcgtacgcttagccattggatttgtatttccaccgtagaaacgggcatctccagttggtgacttcacaacaacctggtcaccaccacggcccaaagccaaatccaagttagcttgagcattctgtgccagaacatcaatcgccgtttctttataagcaattccaatactcaaggtaatgggcgtattttgcattgacgtcgcttcgcggacagccgtcaaaacgttaaacttatccgcctcggcacgacgcaagccctcacgataaccaatcaacatgtaccggtcgactgctaaacgacgcacgtaaatcttgtgctcagccatccaatcagacaatgtcttcgtcacgaaggtacgtaatgcagaagcatccgagtcgttcataccttcagacacttcgtcatagttatccaaggaaacaattccaatgaacaacttgtgcgcctcgtagtcactcatgacttgtgctgaatcagtcgcatccaacaaataagcagcccgaagttctggttgcacttgcacattaaatacacgatccaaccaatgcaattgggtcacacgcttatcttcatccggccatcgcttaatcaaatccgccaattgcacagaagcttcttgcattggtcgaccaacaatgacccgttccccaaggaaactttgtagataaggatttacccagttaatttcattctgttcattgaacaaaatgacccccaaaggcatctgaataatcgcttcttgttcaccacgattaacgcggtatgaaagattctcaatatagtgtgtggtgtcttcgccaataatctgcaaggtcttgaatatgaccatcaaagcaatcacaaccaaggccagccagacaattccggcaacccaattcaccataaaggctagaatcgcgccgataattgccatcaccgagacgagcactgccatccaagcgaggcgccgattttggaagaacgccggtaaagcatccaaatttttcacgcgtatcacccaacctattccttaatagtttctttataaagtagtataccatgattaccaaatagacttgaaccgataaataatggcttttttatgtaaaaacatttaggggcgttgtgtgacgtcgctatcgcgccgagttggtctttgggtgagcggggtggtgctccgtcctacaatataagctggtggcaacggagtcccattctccctaagcctcagcgtatttccgcgcatgccggcttgaaatccactgctgctaagtgataattggtgctcatgtccttgcttggtcaccggctaatatcgcaggagctccacaccaccccactcacccaaaaaccaacagcagccaatcaatactctaattgttctagtttcatcccccagccccatgcctcgacgcaacgcgtcgaccctaacctccaactaaattaaaaacgcacccaacataacgtcaggtgcgtttcttgttaatcgatcaaaccagcttcgcgggcgcgttgcttgtacatctcgatttcgtcttctgcagcccaaacgaagtgttcaggtgcaatttcaaccatctcacggtcacgtccgtccatttcgtcagttggatcgtaaacgattggctcacgggccgtctcaactgatggatctggaactggaatagcactcaacaatgagcgcgtgtaatcgtgcaaaggcttgttgtaaacttcgtcggctggtccaatttcgaccatctttccccagtgcataacaccgatacggtcagaaatgtacttaaccatcgacaagtcgtgggcaatgaacaagtacgtcaatcccttgtccttttgcaattgcttcatcaagttaacaacttgcgcttggattgaaacatccaaggcagagattggctcgtcggcaatgatgaactttggttgcacagccaacgcacgggcgataccaatacgttgacgctgtccaccagagaactcgtgtgggtaacgatttgagtggtcacggttcaaaccaaccgtctccaacaaatcttccacacgctttgaacgatcttcgtcgctcgctgccaagtggttaacgtcgataccttcagcaacgatgtccttaaccttcatacgcaagttcaatgaagcttgtgggtcttggaaaatcatttgtaccgcttgacggaagtctgacaattcgccacgcttcttcaacttagcgatgtccttaccatcaaacaaaacttcccctgctgatggttcgtacaacttcataatcgtacgaccgattgtcgtcttacctgaacctgactcaccaacaagaccaaacgtctcaccttcgtaaatgtcgaaagttgcgttttgaacagccttcgtttcgttgctacggcccttgttaaacgtgatatcaagtcccttgatttcaactaacttcttcttttcttcagccattagttgttatcctccgttccaagaactgccgttgcgtcgacggcgactgccttcttacggtcagcttctgggtgctcagcttgatagcgagcccaacgcttttgtacttccaatggtggctcgacttcaggcgcacgttcatccaacaaccacgttgacgcaaagtgcgtctctgatagcttgaagaaagggggcttttgcttttcatcgattgccaaagcgtacttgttacgtgccgcaaatggatcaccaactggtggctccaacaaatcaggcggcgtacctgggatagcttccaactcaccacgcgccgtttccgtcgttggcattgagttcaacaagccccaagtgtatgggtgttgtgggaagttaaacacttcatcaacagttccaatttcaataatttgtccggcgtacataaccgccacacgatcagccataccagccacaacaccaaggtcgtgggtgataaagatgattgatgaatcaatttccttttgaatcttcttcatcaagtccaagatttgggcttgaatcgtcacgtccaacgccgtcgttggttcgtcggcaattaggatttcagggttattaatcatcgcaatcgcaataacgatacgttgacgcataccacctgagaattggtgcggatagtcattgatgtggttttctgaatttggaataccaaccaacttcatcatttccaatgccttagcccaggcatccttcttgctcatcttcttgtgcttaatcaaaggttctgcaatttgttgaccaatcttcatcgttggatccaatgacgtcattgggtcttggaaaatcatggcaatttctgaaccacgcaagtgctgcatgtcttcttctgacttaccaatgatttcatcgcccttgaacttgattgaaccatgttcaacttcagcattctttgccaacaagcccatcaatgagcgtgtcgtaacagacttacctgaaccagactcacccacgatagcaagcgtctcacccttgtacaaatcaaatgaaatgtcgcggatggcttgtaccttaccgttgtaagttcggaaattaattttaaggtccttaacctcaagaatcttttctgccatgtcttaactctcttccattaatccttcgtacgagggtcaaaggcgtcacgcaaaccatctccaagcaagttaaaggcaatcatgatgacagccaagataagtgctggaattaccaattggtatggatagaattgcaaagccttttgtccgtcgttcaacaacgtacccaatgaggccattggcactggaattcccaatccgataaatgacaacaatgcctcgaagaagattgctgatgggattgtgaacatcaattgcacaataatcgttgaactcaagtttggtaccaagtggcggaaaccaatacgccatgctgatgatcccaatgtacgagcggccaagatgtaatcttgttccttaatcgtcaatacttgcgcacgtatcaaacgtgccattgacgtccatgatgtcattgcgatacccaatgcgattgacaacataccgggcttcaaaatcaaaatcaacaaaacgaacacaaccaagttgggaattgatgaaataacttcgatgatacgttgcatcacaatgtcggtcttaccaccgcgccaaccggaaacaattccgtatgtgacaccaaagaccaagtccatggcagcggcgatcaacgcaacttgcaatgagatacgcgttccgtaaaggacacgcttgaagatgtcacgaccaaattggtcagttccaaaccagaaattcttcttctttgaaacgccagctgaatcgtatgaatcaaccttgacaccatccaactttgcatgaccagtgaaccctggaatatctcccaagacacctggcaaacgtggtggcaagttttgcaacgtaacatcttggtgtgacgttgactttgagttggcaattggtgcagaaccaaatgctgccacaaaaatgaaaaccaaaatccacaatgagatgaaggctcccttgttcttcttcaaacgacgccaagcatccttagcgaagctcaatgaaggcttcataatcttttcgttatcgacatgacgatccgctggaagcagcttaaagtcatctgccgtcaaatttacttgttcagccatgtgctactccttactttgccaaacggatacgtgggtcaatgacaccgtacaagatatcagtaatcaacaatacaaccatcaacatcatggcatagacaatcgtcgttcccatgatgatttggtagtcattcgtcaaaattgatgaaacgaattggctaccgattccaggaattgagaagattgactcaacaacgattgacccagtcatcaagttaaccgccattggtccaatcaacgttaccaacggaatcaatgagttacgcattgcgtgcttccaaatcacttcacgctttgacaatcccttggcacgtgccaattcgatgtagtcagaacccaaaacatccaccatttcggtacggatgaaacgggctgacgttgccaaaggtgccattcccaacgcgattgttggcaagatagtagaagagaagcccttccaaccagcgattggcaaccagtccaacttcaaaccaacccagtattgcaacaaagccgcaaacacgaatgatggaattgaaattcccaacacggcgatgattgacaagattgtatccgtctttgtgttacgacgaacagcagccgctgaaccaagtccgataccggcgataacaccgaagatcaaggcttgaattcccaattgcgctgaaggtcccatacgttgtgcaatcaacgttgaaacttcttggttagcaaattggaatgacacaccgaagtcgaaatgcaaggcatcccacaaataagtgacgtattgaatgaaaattggcttatccaagccgtactgtgcttcaatcatcttttgttgtgcctcagacaaacgctcagcattcgcaagcggtgaaccaggcatcagcttcatcaagaaaaatgtcgctgagataatcagcaccagcgtcaaaataatgattgctagtcgcttaagtaaatatttgatcatagcgatgaccttcccctattattcctgctattcatattatgaaagactcacttacgtttaattaaaaacgaggttgatatctctcacatatccatagtttttattagtattttctaatcttaccagacaagtcccgattataaaagggtttgtcaggtaatatcacatgagaatcaaaatttcttaacacttacgaatttgttagcgtttacatagattttgatatgtttgtccagattctgggacgctgttgcactcgccctatatgtaaaacacgcatctatccatagtagatagatgcgtgttgtctattcaaacttaacaaacaagtgtcgttttgattctgcaatcaaaattacttcttgtatgcccacttccagtcgtaaggtgcaccagcagggttcataacaacacccttaactgacgtacggaacaaagtagcgtatgaacggtagtacaaaggtgccacaccgacttccttgtcgatgatttgctctgcttgcttgtagtcgtcgtaacgcttcttgtcgtcgttaacgtcagtcgtcttagcagcttgcatcaactcgttgtattgggcgttatcccatgaaccgttgttgaatgatgaatccttcgtgtacaagtccaagaacgttgatggatcaccgtagtcggctccccatgcagtgataaccaagtcatacttcttttcttgtgacaaagccaaacgttgcttaaatggtaccgtcttgatgtcgatcttcaaaccgtccaacttttccatttgtgattgcaagaattgagcagtacgctttgcaccgtcagtgtcatccgttaccatttgcaacgtcaacttcttaacgccagcttccttcataccttccttgaacaacttcttagccttagtcttgtcgtatgcaattgcaccctttacttcagctgccttagcaaagtcttcgttcgtgttaggatcaacagccaacttagttgacgtaaacgtcgttgctggcgttgcagttcccgtcaaaatcttgtctgacaaagtcttacggtcgattgagtatgagatagcttgacgaatcttttcgttagccaaggccttaaccttcttttggttaaactccatgtagaacgttgaagcttgtgggataaccttgtaagccttgttcttcttagaagccttaacttgatcaggtgacaagttagtgaagtcaaccttacctgacttgtacaagttgtaacccgtgttttggtccttgattgtttgaacaacaaccttaggcgtcttaacaaccgcagcatcgtagtacttgctgttctttaccaatgagtacttgttgtttgaaccagtccagtccttcaagatgtatggacctgatgccaacgtgtacttagcggcagttccgtacttcttaccaaccttttccacaaacttttggttttgtgggtagaatggtgccatcgtcaatactgactcaagttgtggcattggcttttccaattgcacttccaaagttgtgtcatcgactgcagttacacccaatgatgacaaatcagtgttttcacctgattggatagcatcagcgttcttaatacctgagaacaagtatgcgtattgtgatgccgtctttggatcgttcgtacgttgccatccgtatacaaagtcgtgagccgtcaaagcgtcaccgtttgcccattgcaaacctgaacgcaacttgaacgtcaatgacaagccatcttctgacttctcaacagattcagccaaagccaaagctggctttcctgacttgtcgttacggtacaaaccatcaccagtggcttgcaacgcatcaaaatcaacagcagcagtagactttgaagggtccatagttcccaagtcagcaccttcagtccagttgatcgtcttgtacttagcagcatctgccgtcaaaggtgcaaccgttgatcccaaaatcaaggccgttgacaacaatgctgacgtcttcaacaatttgttcataaaataactccccatatccagaaaatgtaaataacgtttttcaatatgcatgtatcatatcctggacgaaaatgagaagcaatgccattttttaatacaaactgtgaattatgtttgaatttcagacaataaaacgtttaaaccccgcgttatatcaacgtttttaaaaatgagaatattactcattttcatgtcactttcacatgttttttgtgatttattacgttagttcgcaaaaaaaagctcgcacctgacaaagatgcgagctttttagcactgtctattcaattaacgcaatgcgattgccatgtagttcatgaagcgctccaagtagaacggtgcatcaaccgcaacagctgcgtatgtgttcttgactggatcagtcaaacggctcaaatcaccaatcgtacgaccatcttcgtggtcgacacgcatgttaattggtagcaaggttaccaagttagggtcaactgccacaccaacagccaatggatcgtgcaatgcggctcccgccttgttgatgtccaagttatagtaggcatcaatgtagtaatccatgatgtcagcataggcacgtcccttttcggtacccaagtcacgccattgttgcgtctctttctttgtgagcaaagtttgcaacgtaacgtctagtccaaccatcaccaagtgcttggcattcttgaaaacataatcggcggcttcagcatcttgattaatatttgcttcagtataaggggttacgttaccaggtactgttagcgcgccacccataatcgtgatattaccaatcaactcagcgatttcaggatccttcttaaatgccaaggccaagttagtcaaaggaccagttggcacgataaccaaattctctgcatattcgtgagcggcttcaataaggaagtcaacagcagattgatcttcgattggatgctttggttcaggcaaaaagacgttaccaataccattgtcaccgtggatgtcctttgagacttgcattgcctcaaaactatccgtgttcaatgagtggcccacaccacggaagactggcacatccgttgcacccaacaactccaacaacttcaagctgtttacagacgtaatgtcttgtacgttgtttccgtatgatgatgtgattccgatcaaatctgcatcaggcgttgccaatgcataggccaaagccaaggcgtcatcaacacctgcatccaagtccaaaatcatcttcttttgagccatttttccattctcctctatatatacaagttttactattttatttaagcattcatttgttgcacttgtgccaagaaccattcgttgaaacgttcggcatccacatcaacaccaattgtcgcattaacgaagtcattttcgtgccaacggtgttggaaatcccaaaccgttgcaccggctgctggtccttcagtgacaacgtcaacggcaccatctttaacagtcatgcatgatggatcaaccgcataaaggattgtgttcacatcgtgcatcggcttaccgccttcatgaacatcaccataagccgtaataatatgactcaacatattaccagccttccccatttgcgtgatggctgccatcgtttctggtgtaattaacgccttcaatgttacgtccagcccaatcatggttttcttaactggtgcttccatgacaatcttagccgcgtctgggtcagtaaagatattgaattcagcaactgatgagacgtttcctcctgacaccgaaccacccatcaaaatgacctcatcaatattgaccaaatcaaatggataattttggaacaacgtcgcaacgtttgtgtaggcacccgtcgcaatcagcgttactggttgtgagctggtttgcaacaccttgtgcatcgctgtcaccgcatcatcttcaatcggcttaatcgtgggttctgggaaatcatatcccggcatccccgactcaccatgaatgttggctgcatctgcgaatgccttctttaacggcttagatgcgccggccgcaaccgggatgtcttcacgatggaaaaattcaagcaacttcaatgcattttttgtcgtcttatcaactgaaacatttccagcaaccgtggtgataagtgacacattcaaatcagggtgattgacggcaactgcaatcgcagcggcatcatcaattcctggatccatatctaagataacctgacgcatgattttttacctcttaccaaacaaagattccggctgtagcagcagctagcaatgaaaccaaaatacctgaaagcatcaagtatcctgcttgagaactaatcaaatcgttaaccttcttaccagtcaatcccttgaaagctccgataatcatacctagcgttccaaagttagcaaaactcgttaggaacactgccgtaacagcaaccgcgtgtgggttgtggaacaaaccagttccagccatgattgactttgaaatttgacccataacaacgaattcgttcgtaaccaacttcaatcccatcaattgagacaagttgaaggcatcagctgggttgaatcctagcaaccaagcaaatgggaacataacaacaccgataatcttctccaacgtcaaccagtggaagccagtcaatccaagcaattgatcaatcaaggcagccaaaccaacgaaggcaataaccgtagcggtgatgatcaaaatcaacttaccagcacccaagattgagtttgacaagaatgagaagaatggctcgcgttggtgaccttcttcagtgctttcgttaacaataacgtcttctgatggatccaattgcactgggttcaagattgctgtaaagacgattgaagccaagatgttcaatggcacggccatcaaaacgtattgtccaggaatcatctttgtgtaagctcctagcactgaagccgtcacacagctcattgacatcatggccaacgtcaaattacgttgtgctgacatgcggttcaattgtgcctttgagacggccaatacttcagtgttaccaaggaacatcatctcaactgagaagaatgcttcaaactttggttgacgggtgatgaatgacaacccacgtccaacccacttaataatccaaggtagcacaccaatgtaagtcaagatgtcaaacattgggacaaccaacaagattggtagcaatgctgatgtgacgaagtttggtccgccgtggttggccgttagccaatctggcaacgcaaacgcaattccttggttcgcaacagcgatcaaccaagcgaaaccacttgcggcacccttgatgatatcttgaccaatcgtgaacttgttaaagaaccaagccaagaccaacatcaacccaacaatcgtgagaacagaacgccaatcaatggccttcttatccatagagaacaagtacgcaattccgataagaattggaatagcgatgatgttaacaatcaaaaacataacgatacccccaaataaagataaattattttacaatcacgatatttcgtgtacaatccttgtaaaacgtttttgtaaatcgttttacaggtaataatgtaacatgcttcacaagatttagaaagcgtttacactcggttttttcgaaataaaggagatttttgcattaaacccgcatcctgactgtgatttttgaaaattccaacgttgctctgtcactaatcagaataaaaaaggagacattatgttttatcttattggcatcttatctggattgatgctagctgttcaaaatccatataattcaaacttcggtaagcaactggcatcaccaattgccggtggattcatggtttacgttctaggaacgattgaattccttctcttgttactgatcactcgcgccaatgtcgctggcatcctatcgctaggttttggtcacggtaacatttggttgctcggtggtgtaatgggagccgccttcatcaccagcatcatcatcttgttccctatcttaggaccaatcaacgccgtcatttatccaacccttggtcaaattttctcaggtctcatttatgactggaccggcgctttcggttcacatcaagtccccgttaaggtgattgcaattatcggtcttgtcctactattggcaggtgttttcctaacatcatatgaaaagagcttgccaacaaatgcgcctaaagccaatatctggcaaatcatttgggcattgattgctggtgccctttctactacgcaaggtttgtttaacggtcaattgtctgccattgttaagaacgcttccggtgcgtcatttattgcctttctaatgggaaccgtgttcttgctaatcgtcgttatcattacaaagtcacttcacaaaaacacattgcccactggtttgacatcatttactggttgggtcgcttcaacattgggcgctgcctacgttttgattatgaccatcttgatgcctacccttggtgctggtcttacaatcggtttgtcacttgtcggtgtcatggttggatcagccttggtcgaacaatttggtctattcggagtcattaaaaagcgcgtgactatccgcaagattattggaattttgcttttcatctgcggtgttgtcctcacgaagatgtaactatcccaaatacgattattatgacgattatcattaacgaagccgttatgataatcatgttggttgtaaccaacgcccattttatatggtgatgtcacatttctttacaaagtgttttcttatcacccattaagacatcacacccacatattccaaaaaaagcatccgcccctgtactgcggatgcttttttgtatcgtgtgttgtgtgtcgtcgctaaccattatttgcaaataaaaaatggccaaccgaagtcgaccattcagacaaaaataaaataaaccctcaccaaatataccagtgggtaagtatacttgcatatagagagaaagagagaggggcgtattagccatgataaccaatacgcaacaccgtatgtgccgaaaaatcacatacgatgtgaaactatgctcagttctataaaagagctgcgtagacgtactaccacacttcgattgtaagtgatagggtatcagccatgtagtgaatgtaccctgtattcacgcgattttaaatagaggtacaggtacatttctcatacatctacggttgttattctaaactagatattgccccctaaatgtattatttctttattgtgagtatctttactcccagttatattcattatgctattccttcaaaaaactaataccttttcaatgtgaataatctgttatccgactgcagccgacatcttttccactttaagggcaacctcacccaacaaatcatttaaagcagtatatttagacatgtagttaacggtgcgtacattaactacacactcctataagtagacgcatagtctattttcgttttctcagcatcattcgctcaatgctgagtttttttatttgtcggcatatcccgtttactaattaagggacacccctcctaagcgcctattaatcggcgttataatggcaccgtaccgttgaatcttactttactaaaattatcgtctaattgttattgatgagtgctttgcttcaactaacacatactattacccattcaacgatacattaaaaggctagtgcatttgcgctagcttttttaatttagtcaccatccgcaattctgcgatcgaacaactgctttttcatggtttgtcgtggcatattcacgcatgtcagcacgccgtaattcatccaacgctgaacataaatggcgatgccgctcatctttagaaataaacatttccaaatcaacaatcccaaactttgctttcacaatttcattatcacgccattgaacaataattggtccagtcaccttattcggctggctaaacaaccggtgttgctgctcactcatcgtcagagctaatatttctttatctcgcgtagctttgctagtccatgctaagacttcacaaaactcactaaacgacattggaaacgcctgtttaacctgaatcagacgatatgtcagatgatgttgctgcaagaagtctgccacctgctttgacactttacgttgcttgcgtgtaccgacaacgtaaagttcaagtccatcttgatgtttcataattgcgcatcccccttcttcatattcacttccatggtaaaacaagccgataccgtcaactccagctttacctcttttgttgtaggaaaccggtcctaaaaacgttttttacaccaataaaaaaagcagatcattactgacctgctttttgcggactacttctgtcgtccatagattgattctgtaaatttgttcatcgttaaattgaccgccgtatgcaagaatgaatcaaactcagcaaacgtcggcaacgtcgtccaaacaatcacctgcgctgcttgcgcacgaggcagtaaggtatcactgataatcatgtcgcattgcttcatgtcatcgctcacatcaatacgtagttcagcttgacgttcaagcatggtcgccacttctttatgcataaacgcgtcattaatccgcaagctaatatgcaattgcggaatcatgacagcacggtctaatagaccgatgaataagttataaaacaccttgaacaaacggttcttaatattaagcgtcttgatacctaagtactcattgactcgtgttaggaagcgatctgtaaacaaggtgtactcagggaataacgagtggctaattgtgtaatcgtcatttccttgataattgatatgcgtcaaaaatagcagcatcatcgccggttgctcaagttcattggctaattgcgtcgttaaatcttgtggcatatcttgcccaaagaattcacggtacaccgtctggtcaatgttgctcaacatcgcatggactttccccacttctttgttagcattgccactcaaatgaccggcagacagcccgacgcgtaccagcatcaagacgccataacgactctccagtgacaactcatgcggtggcaaacgaacaaatcgccggataactgactcgttcagaatcagtaagtttttgtatgcctcatctagttgatcatctgctaatagaacatgcggttgcgtagaatttgaaactgggcaacgtgcattcaagcgcacaagccaaaccgccaactcaatcatcaatgacaagtgttggtgttgcgttaactgcgctgcttcaacattcgacatttgataaaaacgtgccacttgattagcttgctgaataatatcagcttcaaaaaaatcagttaattcggtttcatcatgaatgacgtttttaaaaatgctaaccagcataatacgaattgcccattcgtctccctgtagccgattataagtattaatttcaatattcgctggtcgcgcacgatcattaaattgacgaatatcattttttaaatgcagttttgggacatcaaggtgttctgccaacacagacaaggctgttggtgtattattcatccccgttattaatgtacggaataaatacgactccttaatatagcttgctgttaagctaagcaagtaggctcggttaccaggaattaattccacttcacgttcagatgggctcaatcttagctgtccctgctctggcataccaaatcgtttctgatcatgtagcaattcattaatcagtgatttgatcatgtaagtggaccaattgaaatggcgttccaaatctggaatcaacattttcgtttggttcgtctcataaaagtagctaaccaatgctactttcttaatttccttttttcccagtaaccactccataataattatcccccgacttcaatccaatatagcgttagcataaacgattggaaagagtcgtccataaaagcatcgaagtactcccagttctccttcgcttggaataatttgattgactctttgacagaagcatatttggtttgtgctagggcaactttttcagccataatcagttgagtaatctcaaccatttggcgcaaaaatacggtcatccaatcatccacctcaaaaggtaggctgaagaaagaattcaataaatcatgaacttcttgactctgtccacgttggatactaattaacaatagctggtataccaaaaagctgattacgtgcaacacatcatgacgcgctgcatcgtgacgctcctttaacttttgtgttaggaagcgaatgctggtcattgccttgggataataagccaaaatctcatcatatgtaaaataatttagatatagcaggaatgctttgagttcggccattgtgtagtactctgagcgtcgcaagacatcattcagtactggtttaatgcgtttagcttcttcactgcttaagacaacaggtcggaaatcatttttgtcttgtaaattaatcaatcctgatatgtcacgcgtgcgttggtattcagcgattgcagcaattaccggactagttgcctcatcatcaactggtttcggttcaataaataagcacaattcatccaatccaacattaagcgtgcgtagcattgcgtgcaacttgtgcaccgtaatgtcaccttgcccatttacaaacgtgtagtatcgactgctagagattccagcatgcttcaagatatcgcacactggaatatgcttcatatcgatcagcccacgcacagctgatgatatggttgtatctacctcagttttcatactttctttttctctcttcatctcaaaaaatcatagcaaaagctaaaaatttatttccctttggtcaattaccagattcatctttttcatatcccattaaaggcatactaacattttgtaatacacaacctttagatattttcgaattaaatacgttgggactctgatgttatctatttttaaaaaatttaaaaataaccctagttctttgccatatcacgcttcaatacttgaatttcatccccaccgacaatgacctcatgacagacgttcaagaacaagccgtgctcaacgacaccaacttgatttgatagccatgtcgcaagctcttctgggaatggaattgtatccaaatgcaaatcaataatgttattaccgttatccgtcgttagtggacgcccatcttcatccaaacgcaaaattggatttaaattgtgcttcttaaacaagcggcataattgttgttcaccatatgacaccacttcaactggtaatgggaagtgtcccaactcagcatgttgcttgctaccatcgacaatccaaatgttgcgctttgaattcttggcgacaaccttttcatatagcaaagcagcgccaccacccttgataccattcaattgtggatcaatcgcatcagcaccatcgacagtcaaatcaatgtaatcaaccgcatcgacgtcagccaaaggaatgcccaagcaacgcgcttggtgggcagtacggtttgaagtcgttacgccgacaatatcaagtccttcattggcaacgcgctcaccaagacggtcaacaaaatagcggacagtcgaaccagttcctagaccaactaccatgccattttcaactaagcttgcagcgtattcaccagcggccttcttttgttgttgaatcttgtctaacatatcgtcctccttagtctttattgtgcaatgatcgaacaacttctgagtgagttgggattgaacggattgcaccagaacgtgaaactgcaagtgaagatgccttacatgcatattcaactgcatcggcaacattcgtcgcatccaacttcaattgtgaaactaccgcaccgataaacgtgtcaccagcagcagtcgtatcaactgcctttaccttaaagataggacgcgtgtgggggttcttaccatcaaggttgtagtaaacgccatcttcaccaagtgtgatgatagttccttgcactgacaattcagaaatcgcatcgctaactgccagtaggtcctcatactttgttgatggctcgcgttccaacagcgctgctgcttcagtctcattaggtacgatgatatccgtgcatgctaggatagctggatcaatgtccttagcattcataactggcgctggattcaaaaccgtcttaacaccgtacttcttagcaaggtagaatcccttagcaacggcctcttgaggcacttcaaattgggcaaccacataatcagcatccgcaatcaatgcttcagacatgacaacgtcatcagctgacaactcagcattggctccaccatacacaagaattgtgttgtgcccatcttcttcaagcaaaattgtagctgagccagttgctgtatccttttcacgcaaaccagaaacgttgataccctcatcttctagtagggtcttaaattgttgaccagcttcatccttaccaattgcaccgataaaactaacttctgcaccttggcgagcggcggcaactgcttggttagcaccctttccaccaagattcatgctacgttcgtcaattcgcaaggtctctccttggagaggcaaacgcttaatattttggatgatatccaagttcaaactaccaattacgacaaccttgttcatttctttcaccttttcccttatacatcatttttaaagtattcatcttgtaaatcgtttttgtaaatcgttttacaaagaataatatacaccctttttgtggaatgtaaaccttttcaactcggattttggtaaatgcatcacaaacatattcgtttttgtgtacaaaaaagccctagaaacgtggattcctagggcttttacgtcatgattatttagttggtgcaggtgccgttgattcgcgttgaatgaggcggacatctaaaatttcttcttgcattggcaatgctggatctttaaggcgtgctagcaccatgtccaacgctaattgacccatacgccaaaccgcctgggtcaccgtcgttagagatggcaccgtaaactcagcataatcagtgttgtcatagccaataacactaatgtcttctgggacgcgtaccccgccgttcttaaggccacgtaacaaaccaatacccatttcatcgttcaaggtaaaggcagctgtagcacctgatgcagcgactttatttgcaattgctaacccaccgtgctttgatagcttcgtcgcaatttcaataatttcaacgtcggcttgttcgtcaataaccgctgtgaaccccgagatacgttccaacatatttgttgtcatcacatcgggatgtagcaacgcaatttttttgtggccaagttctaccaagtggcgcgcaactacctggccaccagtaaactcatccgtcttaacgtggtccgagatgttactatcattaatttgatctagcacaacgtaggggataccttgcttttgcagataacgatccacttccaaggcattcggtagcattcgtgcaataaccaaaccatttacaccgcgttccaacatcttaagcaacccttgttcaatttcatcatcatcaactgaaatgaacaccaagtctgcgagattgtgggcatggttttgcatactttgcattaagtccgaaaagaacggattacgcaaacttggtaccatcaccccaatcaacggatttccaccacctcgaagactcttggcactttgatttggcacataacccaattggcgcacggcatccatgacgcgctcaatcgtttcctctggaaagtgatcatttttcttattaataacttgtgacaccgtcgttggtgaaacgcctgccaacgccgccacgtctttaattgatgctttttttgccatgtctatccccctcacgatattacccatgtactctctaatacatatctttacaaacattatacctatttcaactagtaaatgcatttactaaatcgaaaaaatgtatcaaaaaagctgaacaaacgggggattccatctgctcagctttttcgagttgttcacatactgacttatacaagtcataaggagttgtagcgtcaacattagctaaccttctcgtaaccatcccgctagctaatgttgtcatattatgcttttgacatctctacgaatgctatcttaccttaccgattcgtcagtcgggtaatctatccttcctaaaggacagtcaaaattacttggttagcaaaccgcgcaattcaagttcacggtaaagtgaacgtgtcttactgttttgcaagcggatcattcccttatcacgcgcgataagacgaataccatttgcacgtagttgttgctttgcccaagccttagtacctacaagtgccacaacctctcacctctttcccgataatctcatggattaccacagcagctgttggtctacgcccctgacttcagtcaggcgcaagaccaaagacgcacctgataagggcgacttggtcatgtcggaggtctaaaacctccgacatgaccagtctactttatgttggatgcatttttatggctgtcattaagtctgcacctaaccgcaggacaacatggcagaattcctttaaaatggcgatttaattgggcagcacttgggtctattttgctcgttgatagctagcggtaattcgccaaacaatcacactcatcacggccatgccaagagcaaagacgatgtaggcattatgcaagccattgccaaatcctgaaacaattgttgtggcaactagaacaccgacaaccccagcaaattggcgagctgtgctaatcatcgctgaaccatgagtaatgagataatcaggcaattggttatttgcataagtcgtggctggcaacatcataaaggcattaccaacttctccaaatgcggcaaaaataacggccaatacagcgttatgcaagccaaacgttagtgccaatcctgcataaccaataaaaatactggcagctccgatgcgcatgacaacctttagccccttttgatcaagtagctttcctgaacggcgattcatgacggccatcaaagcagctggcggcaccatcaataaaccagaaactaatttgctggtgtggagtacattctgataatacaacggcatcaacaccgtcatgacaatcaagccaatgtacgatgcacctgtcaatagcaaccctaacgtgaaacctgcttgcttaaagaccttaaagtccaacattggttgtgccatggtgccttgacggtgtacaaaatacacgctcaaaaccaagccaatcatcatcatcgcaatcatactgattggcgtagtggtgtgtcccagggactgaatgccaaatagtaccatagcaaaaccgaatagcccaatcaatgacgggatatccaagtgaacttctttcttcacgatgacattttgcccaacgaataaattgaccaaaaatagcacaccaataaccagttcaaagaatacaaagacgccttgccaattgaaccattggctaataataccggacacaatcggaccggtagccagggcagcgcccattaccaggccaaccatccccatgctagcgccacgattctcttctggtgtaatcaacatgatgacactttgataacttgggaataagaagccaactgctgcgccttcaagcacacgtccaaaaatcacccagccaaacccagttgcgttaatcgcaataaatgttcccagcaaaaacatggcttgaataccagctaagaaccatttgaagggaacgcggttcaaaatccaagggctcaacggcatcgtcaccgtcatgaccaacataaaaccggtagttagccactgcaccattgaaatcggtacactaaaatgactcgccatgacaggataaatcgtcgtcatagccgactgactaattgagaaagaaaaactggttagcaacagcatccaaacaaataacgttcgttcgcgcttacttaattgttttgtctcactcattctgtccactcaccatccgcaatgtcacccaataattcacgtgatgggataaagaatagttgccctgacataagttgtgagaacgtcaacaaataatcagacatctcaaccatttgcgtcaacattgccttggtaactgaccaataacgtgaatagccaataaagtaggttcccgtcttgttcaaggccggttctgagaatggcacgttcatacggacgatttgacgctcttcaccatcaatttcgaccttagcactcacgttgtgtgcgttgtggaacttttcttcatcttccaattcaagatcatcatacttgtgacgaccaattgccttctcttgtacttcagtctttagttgtccccagaagtccatatcgtgaagccacttttgcgcaaacgcatatgacccattcacaaactcaggatcttcatcaccaacgaccgcaacttcagcagaatcagctgcgcttggcacttcagtaccgtcgataaagccgataatagcgcgaccttcaaaattacggaagcccttagtttcatcgataaccgtcgtgacatcatgcagaacggtcatgtattgacgcacaacctcatacacaatcgacatgtcattcgcacgcacgtggatgaaaatatctccctctgtcccaggcatgctgtattcaggtcccttaagtcccttgaactcttctagttcagctggaaccggcttgtttgggaacaacgtttgccaagcagtgtaactaaagccgattgcggtcttcaagttcccatctgctgcacgtacgttcattgaacgattaattgcttgtgaacggtcagcgaattccgtgatggcatcttgtagttctgccaacggctttgtacggtccaatcccaacaccacaaattcaacgctttgaccaacgtccttccaaacgtcttgtgcctttgtataatccatttcagccatgataagccctcccaaaagtataattgggcggtgtctcagttctatcaaattagcaagttgctaaataagtgtcataaaataatcggccaaccaagagttgaaagcttattacaattatttaaccgaggcatcccccacatctactattattggcacacttacaacccgtcaacacaaaattcctttataagggaatgattaacgatgtttctccatttttgtgttggtgtttgtttcgccacttgtgcgctagcacaacactacgcacaactccacacaaaaaagcactaccgttcaaaacgaacagtagtgcttttaaggttaagccgccatacgacgatctagaatacgaccaatctttgagatgacgtagttcaaggcgaagtacaaaacagctagtgcaaagaacattgcgacaatcgcatttggttcttgcgcataaataatttgtgcacgatatgtcacttctggcaacatgataatcgttgccaatgacgtgtccttaatcaatgacacgaattgtgacacaatcggtggaatcatcttcttgtaggcttgtggcaaaatgatgtgccacaatgcttgcttgaagctcaatccatttgaaagtgctccttcaagttgcccctttggtacggctacgatacctgaacgaataacttcggccaacattgctgactcaaaaatcgtcaaagcaaaaatcgtagacgtcataacacccaagtgaataccaatctttggcaaagcaaagtacgtaaagaagataatcaacaaaagtggcaaattacgaatcaaatcaataataaaaccaacaatctttgatagataaggaatcttcacgtaacggataacaccaaggactgatccgatgataaaactcaaaataacggatacaaccgctacctcaattgttacccatagtcccatcagcaagaagcggatgttgatccatgagaaagctgacaaaaattcgctcatgattatccctccttactcaacttggcttccaagtaacgcatgtagtaactcattggcatcgtcaaaatgaggtagaaaataccaacaataatgaatgggccaaatgtgtcaaacgtttcttgtgaaatcatgtttgcttgatacatcaaatccataccggcaacgaaggccaatactgatgagttcttgatcaagttaataaattggtttccaagtggtgggataaccaacttaaaggcttgtggcaaaaccacataacgcataccttgccaccatgacaatccgttagacatggcaccttcaagttgtccctttggcacggcgttgataccggcacgaaccgtttcagcaataaacgctgacgtataaagtgttagtcccaacgttccggctgcaaaaccactaatcttaacgatgtttgcaataacgacgtagaagaacatcgtgataaccaacaatgggatgtttcgtacgacttcaatatagatacgaccgataatgtttgcgaccttgttcggaaccacttcaagcaaagcaaaaatcgttcctaataccaatgacccaatcaaagcgagcactgaagacacaatcgtccagccgaatccacttaagaagtcgctagcgtgtgattgaaataatgaaatcattccttagccaactccttccagttcataccttcaacgccagagaaccacttcttggctagcttagcgtatgtaccatcttccttaatttcgtcgatggccttattgaccttcttaaccaacttaggattgttcttgtccatggcaacaccgtatggttccttcgtgaaaggaccaccgacaacttccaatgactttgaaccagcggccattccatatagaataccgttgtcagtcgtcaacgcatccccttggccggccttcaaggctgtcaacgcagtggcatagtctgacaatgcgacaaccttcgcctttggcgcaaacttcttaaccgttacagcagaagttgatccagcaaccgccaagatacgagcacctggcttgttcaaatcgtagatatttttaatcccactatctgacttcaccaagattgattgacccgcgttaaagtaaggctttgaaaaatcgacaaccttggcacggtctggcgtaattgacatcgtcgcaatgatggcgtcaatattaccgttcaacaacattggaatacgggtacctgacgtaatttgcgtcaactcagtcttagcctttgggttcacacgcttagtgatttccttggccatgtccacgtcgaacccttcaagctttcccgtcttaatgttcatcaaccccatcaacttggtgtcacccttaacaccccagaccatcttatcggtcttcttaatgcggttgtacgtttcattctttttatcgctagcttgaactgtcgttgtcacaacacttccggctagtagtgcgatggctgcggtagcaagtaccgtacgccatgtgcgcgtaaacttgcgactcatattccgcacctccctagtggatgatttgtgacaagaattgacgagcgcgtggttccttagggttctcaaagaactcttcagttggagagtcttccaagatttcaccgtcagccatgaaaataacacggtcggccacttgcttagcaaagcccatttcgtgcgtcacaaccaacatcgtcatgcttgagtcagcagcgatttcgcgcataatcttcaatacatcgttaaccatttctgggtccaatgcagacgttggctcgtcaaacaacaaggcctttggcttcatcgccaatgaacgtgcaatcgcaatacgttgttgttgcccacctgacaacgttgaaggcatcttctcagccttatcagccaagccaaccttctccaacaactccattgcaatcttcttgttttctgcttcatcgcgcttcaacaccaaacgtggtgccaacataatgttctctagcaccgtcttgttagcgtacaaattgaagtgttggaacaccattccaacattcttacgcgtacgattcatatccgtcttgggattggccaaatcttgaccgttaacaatcaattgtccttcttgaactggttccaaaccattcacggtacgaatcaaagttgacttacctgatcctgagggaccaagcaaaacaacagtctcaccagcttcaactttaaggttgatatccttcaaagcatggaaatctccatagtacttctcgacgtccttaaattcgatcatcgacatttgggttgcctcctatttgataattctctcaatttaaattatctctctataaataaaaacccgccgcgaatactcgggacgggtcgctactgtaataatagtctgtaagtaatgacagtgtcaaattctttgtcagctttgttgacaacaagtttgtttcttcacaattcctttgccttataggctaattcaacggccaaatggtagtcatcatggcgaatttgtaagttagctcgaccgcgggctttcccttcaccaccaagaataacagctgaagcaacaaacaactcatatgattccattgccaacgctactggttgcaagccgactgtttcaatgcgcgctaatcgttgtgccagcatctcgttcaagccaccgtaaatggccaaaccaccacgctccttttccaaacggaaatatggtagtggtgtaccaggatggttcgcataaatgacgtcatgatcagccgctaaataggccatttgttcatcttcggacaagccaccataatcttgcgtcatcaaaccgtttgattgcagctgttcagcgaccttcgtcaactcagcttgcatgtctggatccgtcactgcactggctggcaaaacgtgttgtcgcccatacaaaccatttgctggtacaaacggcgttgcagcacgttgcgtcttatctgcatccgctggcttaccacccaataacttttcaactttgggtgataaatcccacttgaaagtcttcttcgtaaagtagtagacaacattcaaaaaggcaaagtatgcaatcacgatgaacgctagcagtagacccaagccacgcaaataagcggcatttttcaagtgcataatcgccaagtacaaaacgtagaagttaccgactgacgctaagattgtatacacttggcctttccactttgtattcacgttaaagaagccaagataatgattcaataaatccaagattgtcaacattagtttgtgcctccgttatctgcaggcgtttgcgacgttgaggatgcgcttgaagaaacagcactcgaactaaccgctgatgatgatgacgccgcattgctgctctcactgcgcgatgaactaactgcgctcgatgagactgcacttgaagatgatgcttcactcacagctgacgattcatcagtagcttgagaagttgaaactttcgcacggctttctgacgtgtcgcttgatgacttttcagatgacacattgctttgttgcttctcactagatactgacgtcgatacaacagaagagacttgttttggtgccccattagacgtatgcgttgagacattaacaattgcgtttgccgcactcaatgccaaaataattgaaaccaaagcgaccggtgtaataaacggtggtgtgcgatatgccatgaagacctccttgtttccttacaaactaaccttgaacaacttcttttacaatttcatcaatcgcctgcttggttatctgccaatcatcattaacaacaaccttagcaacatttgttaattcagtcggcaattgtgtgtcgcgctgatattcatcactggccaaacgtgctttaactgccgcaacatcatccccacgcttttccaaacgcgtcaataattctgaagactcactcaccgtcaaataaataacgactgcttcatccggtagttcacgtgcataagtaatcgccccagccgtatcaagtacgattgtgataaatgggttcttttcccacgcacgctccaagccttcgtgtgacgaaccgtaacgatagtgcgagtattcaacactttccagatagtggttttcaccaaaactggcctcgttttcaaaatagtaatctacttgatcaacctcaccatcacgcggtggtcgcgttgtgtgtgtaatcaccttaggcatctcgtagaactcattcaaataattggcaacggtggtttttcctgtgccagtgttaccagttaatacaaatactttgcgcttcataatccaaaaatttctctctgttttcttattaaacttcattataaaaccctgagcttaagttggcttaagctcagggcaaaattatacttattctttaccaccaattggcaaacgcatcacgcgcccgatgattaccatcaaagtaaccacaatcacaactttaatgattgttgggataacgaatgcaatcaaaccagttgcaacagctgtttctattgccatcttagcaacaaaagccaaccacaatgtcccgaaaccaagttgtagaaaggccgcaatcaaattccaaaggagcatcgctggccaagaacgactcaaactagcccccatcccaatgaccaacgggaatagcaacatcccaattaaatagccaccggttggcccaataacgattccaacccctgaggtccagccagcgtacaccggcataccgatcatccctaaaagcaaataaaccgcaaccgctgaaaatgacacgcgtgttgccgcaatcgatgcaattaacggaataatgattgtttgcaccgtcaaaggcacaatcccagtcggaattgacaagggtgccaaaatagcaataattgcagcaaataccgctgccaaaacgagttggcgtgttctcatgaaatcacccatcctgtcattgttagttttgtgatttcacctgagtaaaatgtttggcgttgaccattaacgtccacgactaagccaccatcagcgctcacatcctttgcaatcccggtaatcgcctgatttcccacagccatttcaaccggctggccaattaccagtgaacgttggcgataagccgtcatgacttgcgacgcatctagtgaaaaatagcgaacaaaataatttaataatgtcgccgcaagtcgatctcggttcaccgtttgattcgttagcgcaccggccttttgtgcaatgtcagccggataatcagctgggttgatattcagaccgataccaatgaccaaaaaaccgtcttccccggttgtatttggcacagcttccaccagaataccggccacttttcgttgattataatacaggtcattcacccacttaataccaacctcgaccccaatttcttgtgaaagagcctctgccgcagccaccgcaataccagttgtcactttaccaggtgccaatgtcttcatatcagtccatggccaaatcaatgttaggtaaagtccggttgcttgcggtgagtaatactggcgaccatgacgaccataaccagccgtctgttcatctgccacaagcgccatcggaccgattacgtctcccgctgtaatcaatcgcttcgctgccgtgttagttgaatcgattgtcgtgaaagtctccaccgacaaggtcaccggtgtctgtaagtctgcaagtatagtggtcttatccacgtgttcgtcccccaattctccccaggctgtatcacctcttaatcataccttggtgaccactaaaaaaccagacgtcccaagtggttcgtctggttggatttactgtaatgaaattgcccgttcgtggcgtcggacttccgctacgattggtgaaacaagttttcgaaagcgttttggcaaatcaatcatatgattttccgcttcttccaatccttgaatatgttgttggttaatatcgtgatcaaacttcttgatgaaccaaaccatcatcctatgccaccattttaacttttcagggttaacagcaccctgcagttggtaaaaatgcacgcgctgttgcgctggatagtcaaaattctgtgtgcaaatactactaaagtagtcgcgatcaatcggatgaagcccaactgagaagaaaataatctcacaggcattaagattcgccaactcactattaatcaagttagcaatcttaatacggccattaaaaatcggtcctccaaaaattatcgtgtcgtacgtcgataaatctaatgcgccgatttcgtccaatcgatacttgctaatgtgcaactcatcggcaatccagttagcataagttgcggtgtgtccatattttgtatcgtaaattataaccgcactcataaccaaccctcccgcgactaatttacattaggataccggatggaactatgattctatgcgtaacgtttgactagtctgcgaattaattattgaacaatcccttgaagaagttaaccaatggattccaaatgttcgtcacgaaccagttagctgcttccttcacgtcttcagagttagcgaaatccttggccttagccatgatatcaccagctgaattttcaagcttattagacaagtccttggcgttatcaacaaaggcctttgaatctgaaattggggcgtttgccacgccaaccaacgcttgacccatttgttgtaccgctgcttcagaagtcttaccagcgataccttgcttatccaagttgacgttcaattggttaatcgcaacattaactgtgatgttcgtaccatcttgcttcttctcagccaattcacccgctgtcgttgttacggctgacgttagcttacctgggtagctactgtcgttggcgttttcgttaactgccgtttgcgtagcactcaacatatcattggcggccgtcgtgttgctctcatccaagttaataccatcagtggccaacgccttgtacacaccagccaacgcagcttcaccagaaacctttgagttagccgttaccgtgatgatgacgtcattcacaccagccatcgttgcggccatcgcatattgttgtgacgtcacttgggtaatgttgttttgtccgttatagtccttaatgttaaccaacgtttccgtacctggttctgctggggcaattgacactgaactaatcatagcgctatccgcaacgcctgaaatattcaagtacgttgccgcgtcagcaccagttgtcgttagctttgtgtagttgtcggttacgccaagcgttgatgccaacgtagattgatcagatgcacctgcaccatatacaacgtatgactttgacaatgcacggttttgcacatttgtcgtaccggccgctgaaaccacggctgttggtgtgacaaacacagtcgttgtgactgccgttgcaccaatcaatgatgttgccaacaaaattgtcgtgataaccttactcgttttcatggttaaatctcctcgaatattatgttacataattgtaacacaacaaacctaaaacaaaacttattggtggcaataatcccgtttcgaattgtgaactttttttgaactttttatagacagactgtgcgctacgtacattttgtactaggaaagcgttagtattatagagtaaagaagagaacagattatgagatacgagataagggagaattggttatgaaacgtggaaagtccgccgtgctactagtggcgagcgttggcacgatttttaccactagcaccgtttttggtgatacaacaaatagcactatttcgagcgaacaagcgttgatatccactaaatcaagcgatatcgctgcaacagcggatactgacacgacaccggttgaacaagttacaatcgacaccccatcatctgaacaagcaccaattgaacagccatcagaaacaaatcaaccgacagcgaacactgatgaattcattactgacatcgatatgtcaaatgttagtgatcgcacttcatcgtcggcacctgattcaaccggtgttgttgaaaatgttggggatgccacaacaccagcggaagacgcaactaacaaagttgaaacttccgctagtgacacaagcgtttcggcagttgctaactcagtacgcgtcgtagccacaactgcaactgcggaacatacgccaacacctattgatactgcgccaaaagcaaccacgacagcatcaacggccacaagtgattcagttatcaaaacaagcattcaagtggtgcccgctagtagctcaacccctgcacctaacgaatcagtcgctacgccatcaaccaacagtggcaataccgtcacaacgcaaccaacaggcgccgctagtgttgtgaataaagtcgcagttaaagctggtaatttagctgatacattattgcccgaagccgcttatactgtcgcatggacaccggccgcttttgtattggtaattgctagttttatcgcctgggccgttgcttattacacaattttgcgtcgtcagaagatgcgcgaatatcaaatactaatgcacgactaaaaaagcactcgcaacatgcgagtgcttttgttttacatctattagtcttcgacgttagccaattcgtacattgattgtccaaagattgccattgcacgcgtcaaatctgaaactgggtagaattcgtctgcttggtgcatcgtatcaggcacaccttcgaacatggcaccaaaggcaacaccacgcttcaacaaacgaccaaacgtaccaccaccgataacttgctcacctgctggcaaaccagtttgatcacggtaaacttgcaacaacgtcttaactagtggatcatcaccaggaacgtagtgaggcacttgggcgtgaccttcttgcttagccgttgcgtcaaagcctgctggcaatgaagcagccacgtggccttcgatttcctcagccgtcgtgttttgtgggtaacggaagttcgtgtttacgaaaccatcttccccatcagtaaagcgttggataccaacgttcattgacaagtcgtgcatcaaatcatcgtgcgtctttgcaccaatcttctcagcaaccgtgtcatcgtgcaattgcgttcccaagaacgtcaagaatcccttagcgttgccaccaaagtcttggtcttgcaagaagttagccaagtaagtaccagcgttttcaccagtttcaggcatcgcaccgtgcacttgctttccatagaaagtaaacgttacttggttaccatcaaccttagcttcacccttaacacgcttttcagcggccaagtaagcatccatagctgaaaccaaagcagcagtatctgcagcttcaacaacagcaacagcagttccaggaaccatgtttggacgtgaaccagctgagaatgaaaccaacttcaatgaaccaccttgcgtaccagcaaagcgcgttacgattgaaacgttacccttttcaccgttgatgattgggaattcagcgtcaggtgagaatcccatcgttggcataccgtagtcctcaaagaactcgtccataccagtccagtcagactcttcatcgatacccataaccaaaaccaacttgcgctttaagtccaagttcaagtccttgatcatcttcattgcgtagtaagcagtgaatgaaggtcccttatcatctgatgcaccacgggcatacaaacgaccatcttcaattactggagaccatggatccttcgtccaaccatcaccggctggcataacgtccaagtgaccgatgattgcaacagtctcttcagcgtcttcaggacccaattctgcgtaggcaaccaagttcttgtagttacccgtgcggaatccgtcacgcttagcaaattcttcgaacttcaacaaagcttccttaggaccaggtcccaaaggtgcatcttccgttgcagcctcgtcatcacgaactgacttaattgccaacatctccttcaagtctgtcaacaattcgtcttcatacttcaatgcttctgcacgccattgcgttgtcatatctcattgacctccactgtcatattggttgtaattatacgccattttataaagaaatgcagactttaatcaatattatgcatggcggctaaccttccgtcagtcatattttcttcacgtttgttgcaaaatgtgaacgcttacagaacgctttgtaaatttcggcttttttgtattttatagtgatattatgaacaagcattaagcaattacattttatatacacaggagttagcttcatggatgcaaaagttcaaaaggacgaatttgctaagcttacactgatggatcgaatctcatatggtttgggtgacttcgctcaaaacttggttttcggtactgttggtggatttttgctattcttccttactacggttaacggtatttcagctgcggctggtgccacaattttcttggttgttcgttggatcaacgttgtttgggatccttgggtaggtgctacggtcgacaagtcacatcctaagggtggaaagtacttgccttacctacgtaacttcggtattccgctagttatcttggctgcctgcttgttcttgccagttggacaatggttccctgcatttaaggtgccatatgccttcttgtcatatatggcaacggccatggtttactcattcgttaacatcccatatggtgccttgaacgcatcattgactcgtgataacgatgaaatcgcaaagttgacgacggttcgtatgacgttggctaacatcgcgaacttgttggtttacacttgcttccctatcttcgttcaattggctacgtcagttggtcgcgagtcaaaggatatcggaatgtttggaatccacatgaacttgggtgactactcatcagctcaatcagctggtgcttggttcaaggtttatgccgtatacatggttatcggattcttggctttgatggttacttactcaaagacgaaggaacgcgttttgcctgctgaagatgagcctgaagtaaagtactcagacttgtttgctgagttgaagcgtaacaagcctttgcgaatcttgggattgttcttcttggttggctttacgttcatgttcttcggaaacactgtatggccattcttcttgcaatacaacattggtcactcagagtggaacggttcaatttcattgatcggttcaattcctggaatcttcttggtcttcttgtggcctaagattcgtgccaaggttggtaagaagcaattcttcgctttgttcttggctatcttcatggttggttctgttcttttgtgggcatggactaagaaccctgaaaacatcgctatgggttacgctggtcgtttcttccaacaatggggattgacttcagctactggattcatgtggtcattggttcctgaagttgttacttatggtgagtacacttctggtaagcgtgttgctggtatcatcaacgccatcatgggattgttcttcaagattggtttggccttgggtggtatcatccctggttacatcaacgctgctactggatttgacggtactaagaagatccaatcagctacggctttgatgggattgcaatggtcaatgatctggttgccaattatcatggctgttcttgccatcttggtaatcatgaagtacccattgactgacgaagaagttaacaagatgaaccacgaagttgaggctcgtcacaagaagtaatttcttggttaacaattaagttagttaataaaaacgacgtgaatgtcaaaattcacgtcgtttttttgtgtcgttattataggtttgattgaatgcgggccatgtagtttggcaagaaatcagcaataaacgatggcttgaccacataactatgccctgccatctcttcagcgattgctgagtgtgcataaacggctgcttgtacagccttagttgggttggctttgaattgggccgtgaaaccagcaattgtacctgctagcacatcacccatcccaccagtcgcttggtaggcaccaccgatttgcagttgcttttgatcatccttggtgtagataatcgtgtggtgttgcttaagaacaagcacatcaatgttcaaaatttggcgttgtacctcgttcaattgatgctctgcttgatagttcagttgcaccccactcaagcgcgcccactccatttgatgtggcgtcacaatcgtgaatgtgtcacgcgggaacatcatgttttgttctgccataatcgtcaatgccgaaccatcaacaatcaaaatttgattttctgtgacggcttgcaaaacttgttgcaccaattgcaccgcaaaaccatccgtccccataccaggtcccattaggatgacatcgctgtttgcgattgccgtcatcaagtcagcgttgttacgccaatccacaaacatcgcttctggtgtacgtgtgtgtagtggtgccaaattaatcaaatccgtcgcaactgtcgttaaccctgcaccggcaccaacaactgcactagcggccatcaaaattgcaccaccgtattggatattacccccgattagcaaaacgcggccaaacgttcctttatggctgtcgtctggtcggcgcacaatgacctcatgcaatatttctgatttcaattcactaatcatgccgtttctccaattttgtaagtgttacttaattataacgcgtcaaaacgcaaatttgaaattgtcccgttttcatcacgagttgtcagttgcattctggccactattcagcaaaaattgacagtatacagggaggaacgcaaatatgttaaatattgcttacgtcggatttggtaaaagcacgaaccgctaccacatcccttacttaatggaacgccaagaccgtttcaagattagtcgcgtcgtcacgcccacgctgggcaagcgacctgacgaacaagctgcgttggaaacaactggtacacaattttcaaccgatatcgccgacattctaaacgacgactcacttgatttagtcgtcgtggtcacccctgctcctagtcattatgaagttgccaagcaattgctactagcaggtaaaaatgtgctcgtggataaaccgatggttgaaacattagctcaagccgaagaactcgtcactcttgcacgtgaacgtcacctgttctttatgccattccagaatcgtcgtttcgacagcgactttctcacaattcaacatgtgcttgctgctggttacgttggtcggccagttgaactagagctacacatggatcgttatcggcctattgatggcgtgaaattggggacgcctatcgacggtgcatggtacggtcacggtgtgcacttggctgaccaaattgtcgcactgtttggttcaccgaatcgtgccacttacgatttacgtgcaacccgcgaaccgggcgccactattgatgatcaattcgaagtgaacttgttttacggcgatacctttaaagcaaccgtacaagcaaccgaattagctgcggtcgcctaccctaagtggattttgcacggtaccaagggtacttatattaagcacaatattgatcaacaagaatatgatttgaagactggaattatgccagggatgcctgggtttggggatgatgcaccacaagattacggtgtcgtcacttactacaaccaaaatggtgatcgcattaaaaaggtcatccctactattcacggtgattacggtcgtgtgtacgattcagtgtatgacaccctggtcaacgacgcaccaaagttggtatcagatgaacaaatgctgacagttatcgaacttttggcggccggttattctgacgcaaagccccatgtgacaacgtttgaccgctattaaaaatttatcacatctttttcaagggtttatccttgtaagcgtttacatgcaatgttaatataatggtgtaccaaaggaaaggaaggtaaaggatttgaaagaagttcttaattcgacctctatcatgactctacataccaaattccatgcgggcgtgtcacagtaatgacgcaagataattaacgtattgttttataaagagataaacacctaagtcatgtattgacatctcttgcgatcattagcatcggttacttcgacaaagtacgataacctttttaaggcgtaagcatgtacggcgattcgaaggctgctcccggcacggtctgcttttcaaacagatagacatggatgcggtagagatagagacggtgagtttggttgcgaccataccctagcgacagacgtttaaaactgcagattaaacttctagggtggtccatctacaattgaatacagggtggcggagtagcgtcttccttgttacgtgtcgcaaagcgtaacgaaagtttaccgcgggtcaacgtaccggcggtttttgttttgctctttaaaagttttttttgtggttagtgtcgtcgctatcgcgccgacactaaccactgccctactaaaaaacgactaacccgcaagcgagttagtcgtttttttcttatagtgtcatgcggtactcttgcaaaagtccttcgcgtacacctgatgctgagaagataaccttgtcagcgccagtacgtgaaatcaactctaccagtggcaacaaaccactgataatgatatccgcacggttagcttctgtgcccaaaacttcagcacgctctgcatgtgtcatgttggccatttcatcaaacgtcttcaaaactgattccgttgtcatttcatagccgtggaagtttgaatccgctggcaagccgtgacgcaaacggtcaagacgagccaatgagcggttggcaccacctaacaaaatgattggcaacgtcgtcgtgtcttccaaccatggcaagtgatcgtattgatcagaaacgtattgtgaggcacgctcaattaggctcggctcaatcttgccttcgccattcaaacggaacttttctgacaagttaaccgccccaaatggcaaactgataaagtttgcggccatacgttcttcaataccaaccagctcaacactggcaccgccagtatcaagtaaccaggcatctgaaatatccaaggctgaaacagccccaagatagtcgtaataagcttcttggtcacccgttagcacacggatttcaacgccgactgctcggtacacacggtccaaaaagtccgcttgattcgttgcttcgcgcacagctgcggtcgcaataccgacaactgaaacgccctcatatgccatatagtcatcacggaactcaatcaaagcttcaacaacgcgtgtcattgccgcttcagttagttcacctgcattttgatccatcccctcagctaaacgcgtatctaacttacgacgcttaagctcaacgaatgtgccatctgcttgtagttcttcaacaaccattcgggttgagtttgaccccaagtcaatgactgccaaatagctcataatttatacccctctaaggattaaccccagtattggatgcccattgcgttacggacttcgttcatcgtttcttgcgccttagcacgtgccttgtcagaaccatcgcgtagcatttgcaaaacggcgtccttgtcttcagcatacttagcacgacgctcacgcataggtgccaattcggcattcaacacttcgaacaagtacttcttgatcttcatgtcacccaagccaccagcttggtattgtgccttcaattcagcaaccttttccgtatccttgtcaaagatgtccaagtacgtgaagaccatgttgccttcaacgtgaccagggtcttcaacacggatgtgctctgggtcagtgtacattgacttaaccttcgtccacaacgtgtcttcatcgtcgcttaggtagatggcgttgttcaatgactttgacatcttggcattaccgtccaaaccaggaatacgaccttggccctttggtgggaacacaccttgtggttctaccaaaataccttcaccgtagtagttgttgaaagtacgtaccaattcacgcgtttgctccaacattggctcttggtcatcaccaactggcacaacttgtcccttgaacaaagcaatgtcagcagcttgtgaaactgggtagatgaagaaaccagctggaatactctcaccgaatcccttttgttgaatctcagtcttcactgttgggttgcgttgcaaacgagcaattgaaaccaagttcaagaagtactcggtcaattctgacaactcaggcacagctgattgcacgaaaatcgttgacttgcttgggtcgatacctacagctaggtaatccaaagcaacttccaacaatgagttgtgaatcttctctgggtcgcgagcgttatcagtgaacgcttgcttgtccgcaatcataataaatggttcgtagtcgcctgaattttgcattgcgacacggtttttcaaagaaccaacgtagtgaccaatgtgcaactttccagttggacgatcaccagttagcaaaacttgcttttctgccatgttttccatctctttctatcaacggttccccgtcaaaactaattcgtcattgttcattgtaagagtttttacacccgataacaagcgcacaaactacctgttttttaatcgcctaaaacactaatatccaacgtctcttgcacgtcgcgaatcaaacctgaaactggccccacgctaatcaacgtcaacgcgtgcatggcgcgtgatgccaaggtatataacaatccggtcgcttcactatctggataattagtttgtgaaacgtcgtatccaatgactgcatcgaattccaatcccttggccaaatagattggcatcaccacgaaattagatgttcgtgtgcgatcactagcttgaagtaattggaacttctcaggatacttacgtagcatgcgggccacagcttcggcttggtcttgtgttttagtcaaaatcgcgaccgttcgatggtctgctttgagttcatcgacagcctgccaaataacttgttcctcttcgtccgccgtcgtgacaattagcttaggcttcccacctggtcgagtgaacgccatgatgttatcaccatctggcaacaatgctttggcaaagtccataatttcttgcgttgaacgataagccttgttcaaggtaatcaaattagggtgtgtcgccttaaaggcctggctgtacttagccaacaaagctgccggtgtctcaacatctcggaacaaagcctgttcagcatctcccaacaccgtaaacttagcagctgggaaagcatgcttcaagtacaacaattgggccatactgtagtcttgcatttcatcaacgaagacgtagaacatcgacttgttcgtaccaccacccgtaatcaaatcacgcaagaacagcattggtgccgcatcttccaaatcaatgcggtggtactccaactcacggaggaagcggtcacgctttgctagccaccactcagtatccaactcagaatgctcagccatgtaagccagaaagtcgccgtattgattataaatatcaaagaagtgcatgttgtacaacgcatcatcgacaacctggaattcacgttgcaataaacgcttagccgcaatgttgatggcatcccccatctcttcttcttcagcaacttgctcagccagttcgtcacctaacaaatcacgatattgttggtcgtccaagttgttcagctcttccaacacccagtcttcgttgaccaattgatcaatacgacgttccaaacgctccatgaaacgcttttgtgtcatttgaatacgttcacgaaccgagtaattctctgagaactcagcaaacacacgtgtcatcgcttctttaccaaagaacacttcatcttcaaagtagatgttgtcaaagcgcaacgtatctggtgtgagttgttcaacaaaggctgttaaatcatcaacaacgcgcgcactttccaatttctcacgaaccttaagactagccgtcgtcgcttcactgtgaccaatttcataacgttcaaacagcgtttgaacctgcagcccttgtagacgcgcactaaagaattccgccagtgtgacttggcgcatgtttcgttcacccaaagatggcaaaacatccgcaatataacttgagaataaacggttaggtgagaacagtacaatttggtcagaattcaactcttcacgcgcgtggaacagcaaaaacgcgatacgttgcaaaattgcagatgtctttccagatccagccacaccttgcacaaccagcaaatcactggtcgtgtcacgaataatttgattttgttcttgttgaatcgtcgccacaatattgcgcatggtcaaatcattttcttgtcccaaagcatattgcaacatttcatcgccaacggtttcattggtatcaaacatgttaacgatttgcgcatcttcaatcgtaaattgacgcttcttgagcaattcggcttcttgttcacccattggcgtgggatacgtcacggcaccgagcgttccgttgtagtagattccgctaatcggtgcacgccaatcataaacgagaaaatcgccgattttatcctgcaccgatgccaaaccaatgtatagggtatcttcatcgccatcttcatcaatatcaacacgtccaaaatacggactaggtcggagcatggttaatgtatcgaccgtctttcgcataatattttcagtttcagttacacgagccacgatgttacgttgctgttgaatttcggcgttcgtttccatcgcgtcatcgacttcgaaggtattaattgatgtattggcaatataatttccttcaacggcacgtgtttctgagtgagcttgcgcataggcttccttagcacgttcgagttgcccgtcgatttcgacaaccactttatcgagccgcttttgttcagcgggttggtctgcatgcatttattcggccctcactttcgtatattcaattcaactattataacgctttttcaccagaaaaccggtgtaaatggaaaaagcaccgggtctctccacccgatgctttacaaccatttctctttcaccctcttagccactctacctgccaagagagagcccagtgttaacacactgtggcgttaaaaagcttctctactaactttttaacataatttattgtaagtataaaaagtgaacgaattcccgtataaatgtaaagaaattgtgaacatcactttttagtaagtaaaaaacgagcaatcagcgcaagactgatcactcgttaatttgacatctattaagcaaagaagcccatatctgatgcgattgatgggtatgagtacaagttgtgcttaattgcccacttgtcttgcttttggttgatggctaccgtgaagtagttcaacaactcatcagcttcagcactcaaaaccgtcgcaccgatgataacacccttttcgttcaagacaaccttagccttagcaattggctccttgtggcgccagtatgctagccatggtgtcatgtcgattgagttaaccttcatgccctttgactcagcttcgacagctgacataccaacttgccccaactttggtgaaccatacaccatcgttggaatagcagggtatgaaatttcttcaggctcagtaccagtcaacaaaccagctacataacgggcctcataggcaccagttggcgtcaactttggcactggtgattctgcaacgtcaccaaccgcaaaaatgtttgggttagtggtgcgcaaatcagccatcaccttaataccgtttccggcaacttcaacgccagcagcttcaagattcaaatcttcagtgttacctgcgcgaccggcagcgataaatggcatgtcacttgtgacacgacgtccatcagcggcaacaatgtcaaagcgaccgtcagccgtttcttcaacagcagctgtatcaaagttccagtggaacgtgatacccttgctctccatttgcgcaatcaaatcttgcgtcaaatcttgatcaaactcacgcaaaatcacatcgtgcttagccacaacgtgaacctttgcgccggctgctgctgcgataccagcaaattcaattgcgatgaatccagcaccgatgaaggcaacttcttctggcatcttagtcaagttcaagaagtcttcattgtcgtgcaagaattcgtcaccaggcacttccaaacgagctggacgggcaccagtggcaataatccacttgtcagccgtaaacgtttccgtaccagttgaaaccgtgtgctcatccacgaagtaggcgtgaccatacttgtgggtaatgccggcatcatcaagtcccgcaatcttacgtgcaggaactggatccgtgtaggccatcttgtgttccatcaatgcaggccaatcaatctcattgtgaccaatcaaacctgtgtgttgcatccactcagcttgttccttagcttctaccgcagccaaaagaaccttcttaggatcgcaaccataattagggcaggtaccgccccagagatactcttcaacaataacaactgattgcccagctgcttgcaatggaaaggctgctgacaagccagcaggtcctgaaccaataacaccaacattaaagtgttccacgagtatgccctccttctttttataatgtcattattttaacagtttacacacacccttatgcaaaataagggtgtttaaaccagaccaagactaattaccaacgcttgatcaagcttggcaattagatgcccgggaactaaaccgattttatcttgcaatcggcgcttgtcgattgtacgaatttgctccaacaaaataactgaatcgcgtgcaattcctgtattttctaactcagatggcaaacccacgtgggttggcatctttggcttcgaaatttgcgccgtgattggagcaacgattacagtcggtgcgtgttgattaccaacgtcattttgaataatgacaactggacgttgcccaccttgttccgaaccaacaaccggtgataaatcggcaaagaagatgtcccctcttttaatatcatgtcgatttgccatactactctctctacttcactaactttcgtggcaaacgtggtgacaatcccgttgcaatttcatatggaattgtccccatcttgtttgccaaatcaaccaaggtaattgacttgtcgtcaactgacccaatcaatgttaccacagttcccaccggtaattcttctggtagcttgaccatcaattgatccattgcaatgcgaccaatcaattcaatttcacgaccatccggcaacaaggctgtcatgccttgcaacgcacgtgggtaaccgtcggcatacccaactggtagcgtaccaatccactctggttcagaagttgtatacgttgcgccgtaagaaattgatgcccctgcttcaacttgcttcacgtgaaccaactcagcctttagagacaacaccggttggatttcacgcatggccaattcaccttgtgacggatcaaagccatacatccctgcaccaacgcggaccaagtccgtgcttggttgcttatgccacaatgatgtccctgagttcgctaagtgacgccaaatatcatctggcaaatcaagaccatccgtcaattcgtgccagcgttgcaattgttgctcaaagtaagccgtgttgccaccgtcagcggtcgcaaagtgcatcccaattgctttgaattcgacgttctctgtatcatttaactttgcgacaacgcgctcaagttcagcacggtcacgaataccaatgcgacccatacctgtatcaacaccaactgaagcaatgagtgttttatccgctggcaaaagggccaacgcttcatccaaccaggcttcgcttgcaaccacgggcatcaattcaaaggtcgccaaatcattaacatattcagccggcgttacaccaagaataaaaataggcttcttaatgccaaagtgacgcaaccaaataccttcatcgatcgttgccacggcaaatccatcaacgccagccttttcagccgccttaacgatttgtggcaaaccgtgaccatacgcattcgcctttacaacggcaaagaaacgttgggcgccggtcagttcacgaatataagctacgttgtgggccaacgctgactctgaaatttcaagccacgctggacgacgctcactgaccggttggtgtaaagaagccaacgactccaaaataactgaactatgtacggtatcacctgtatgagaaatcgaaatatgtgccaccgcctcgtcttgcttggggtgcttaaccatgactggttgtccagattcgttaggaacaatttccaaatcatgccaatgtacatcgccaccgatccctgttccaattgccttactgtacgcttccttaattgaaaagcgcccagccaagaactccatttggtgcttgcccttacgcttatcaaaaacctcgcgctctgctggcgccaaaatgacgtcaataaactttggtcggcgttctgccaatcgtgtcacatcactaatcatttgggcatcaatgccttgtccgattatcatgctaacttcctcctagattattgtttcattatacgctgtttatcgtcattttactgtaacatcatttaatcaaactaaaaataagcaaacgacaatatgccagtttttggagcaacaaaaaacctccgttcaacacagaattgaacagaggtttcattttttaattagtcgttgttcttgatgacaaagtcacgtgattgacgacgtggtgcacctgagcgaccgcgttgtgaacggtcacctgatccagtgcgtgaaccgcggtcgaatgaacgacgttcacgttgtccgcgctcgccatcacgtccgtcacgaccaccttcacgacggccacggtatccaccgccacgacgctcgccaccttcgcgacgaccaccacggtatccaccaccgttgcgtgaaccgccaccgaagcctgaacgcttgcgaggcaatggacgctcacgtgacaacgtgaactcagtatccatctcagctacgttagcaactgcacccaacaaagccgtagccaaagtcttggcatcgtacttttcaaccaacttgtcgatgacttctgagtcaacggcacctgaagttgccacaatgacatcttcaactgaatcagcagcaactgacatacggccagccaatgcttcttcacgggtaggtggcttcaatggttgcatacgcttcttagtcaacttttcgatgtccttcaagtagtccatctcagcgtttgagataaacgttacagaagttccagtagcaccggcacgaccagtacgaccgatacggtgaacgtatgattctgaatcttgtggaatatcaaagttgtaaacgtagtcaacaccagaaacgtccaaaccacgagcagcaacgtcagtggcaaccaaaatcttgatttcgccgttcttgaattgcttcaaaacttgtgaacgcttttgttgcgtcaagtcaccgtggattccggctgcgttaaagccacgcaattccaaaccacgtgtcaattcatcaacacggcgcttcgtacgaccaaacatgatagccaactttggttgttgcacatccaagatgcgcgtcaacgtgtcaaacttttcaaagtcgcgtacacgaacgtagaattgctcaaccaaatccgtcgtcaattccttggcagcgatttggatgtgctctgggttcgtcataaattgcacaccaatgcgcttgatagcaggtggcatcgttgctgagaacaacaacgtttgacgttgatcaggaacagccttcaagatagattcgatatcttcaaggaatcccatgttcaacatttcgtcggcttcgtccaagaccaaagtcttaacgttagataagttaatcgtgccacggttgatgtggtcgatcaaacgtcctggtgtaccaacgacgatgtgagcaccgtggctcaaaccgttgatttggcggcgaatgtctgcaccaccaaagacagcttgtaccttaacgcgcttatcgcgtcccaacttgaatagctcatcttgtgtttggatagccaattcacgtgttggtgagacaacaagagcttgtacttggttgctgtctgtgtcaatcatttccaagattggcaaaccgaatgcggccgtcttaccggtacccgtttgggcttgtccgataacgtccttaccagccaaagtcaaaggaatcgtttgttcctggattggcgtggcctctacgtagccatgcttctcgatggccgtcaataggtcttgtgtaagacccaactctgaaaacttcaaaatatttcctccagttgcgattgcggagtcaatcgcgctctatatatcgcgaactacgaacaaaattcaaactagacacaatccggcgtccatactgcgtttgattttggcaacagtcctttttgtaacttatccatcttatcctgttaacaactaattagcaagtgcaatagtcattcataaaaaaatacccaacagaaatcaggtctctgttgggtattatctttgttattagtcttcagcaatttggatatcagcgttcaacatcgtcaacttgtgaataatgtgatcgtaaccacgcaaaacgtgttcggcgttcgttacttcagtgataccatcagccatcaaacctgccgtcaccaaagcagcccctgcacgaatctcagcagcagcaacacttgcgccatggaagttattgctgttagcaacagtaataacaccgtactcagggttttcaatcgcgacaccaagcttttgaagctctggaatgtgacgcgtacgttctggataaatcgtctctgaaataatgctctcaccttcagccaacgtcaaaagtggcgtgattggttgttgcaagtcagtggcgaaaccagggaatggtgccgtcttaatgtgaataggcttaaggttttcaacctttggtacaaagatgctgtcttcgcgaacatccaagtccacacccatttcaatcatcttggccgtgaatgactccaagtgctctggaataatgttcttaaccaagacaccatcaccctgcgctgcagccaatgccaaataagttcctgcctcaatacggtcaggaataattgtgtgcgtattctttgactccaacttaggcacacccgtaatacggataacgtccgttccagcaccacgaatttgcgcacccatgttgttcaagaatgttgccaagtcaataatctctggctcgcgtgcggcattctccaaaatggtcgtaccttcagcgtgtacggctgccaaaatgatgttcatcgtagcaccaactgaaaccatgtccaagaagatgcgtgcacccttcaaaccgttttcagcagtgatgtaaaccgtatcgttttcttcacgaaccgtcgcacccaaagcttcaaagcccttgatatgttggtcgattggtcgaggtccgatgttatcgccacctgggaacgtgaccgttgcgcgaccaaaacgacccaatagtgagcccataaagtagtatgaggcacgcaaagacttaattgccgtagatggtaattccgcttcaatgatctccgttggatcaatcatcaattccccaccaacaaaggtagacttaacattcattgattccaagataacttgcaaattgtatacatctagaatatctggcacgctgtcaaacttcactggtgtttcagccaaaattgcggctggaatcaaagccacagtagagttctttgctcccccaactgttacttcaccactgagtcggcgtccgccatggataaccaacttcttcattctttcaccctttataaagcctttagtacttctatgcctacaaggctcgttcatttcgtttaattatgaccgtacagaccaattgattatcatcaaccaggaactcacactgaattcaaagtaacagtccttaacaagtctacattacatttatatgaataacaagaaaactagacacacaaaattaagccataacatttactttatatttaatagtccgaggtgcattttttcataatctacaccattgattacgaataaatacagcctaaataaattttatcggcattaatcaaacaacactatatattatagcaataaaaaagccccaagcccttaaaaacaaggagttgggactaaagtttactcaataaaggactaagcttccttcttatccaatgcagcctttacaaaggcaccgtacaatggctctggacggtatggacgtgacaagaattcggggtggtattgggcagccacgaagaagtcattctctggcaactcaataatctccatcaaacgatcgtcaggagaagtacctgagaagaccattccggcatcctcaaattccttacggtagtcgatgttgaattcgtaacggtgacggtgacgctcttggatctcatcttgaccctcgtaaatgtccttcgtcaacgtaccatccttcaagtcagctgggtacaaaccaagacgcaaagtaccgccacgatccgtaacttccttttggtcgttcatcaaggcgataactggtgctgacgtctctgggttcaactcgattgagttagcatcatcatatccaaggacgtgacgggcgaactcaactgaagccaattgcattcccaagcatacgcccaagaaaggaacattgttctcacgagcgaattggatagctgaaatcttaccttcagttccacgtgctccgaatccaccaggcacgatgacaccatcggcatctgccaacaattcagaaacattttcgtcgttaaccttttctgagttaattgcgttgatttcaacatcagcatcaactgcgtaaccaccggcacgcaatgcttcgttaactgaaatgtatgcgtcttgcaaatcagcatacttaccaaccaacgtaatcttcaacttcttcttcaagttgcggatcttttcgatcattgctgtccattcagtcatgtcagctggttcagccgtcaatcccaaacgcttcaagataacatcgtccataccttgcttttgcatgttcaatgcaatttcgtacaagatatctacgtccaatgactcgataacagcttcaggcgcaacgtctgtgaacaaagccaacttctcgcgcatctctggcgtgattggttgttcagtacgaacaaccaacatgtcaggttggatacccaatgaacgcaactcagcaactgagtgttgcgttggcttcgtcttcatctctcctgcggcacgcaagtatggaatcaatgacgtgtggatgtaggcaacattttcagcacctacttcacgcttcatttgacgcaaagcttcaataaatggcaatgattcgatatcacctaccgtaccaccaacttcagtaatcacgatgtctgcgtccgtcgtttcagcggcacgcatcatcttttccttcaaagcgttcgtgatgtgtgggataacttgaacagttgcaccatcataatcaccacgacgttccttagccaaaacttcagagtacacacgtcctgacgtaacgtttgagtacttgttcaagttaatgtcgatgaaacgctcatagtgtcccaagtccaaatcagtttccaaaccgtcatcagtaacgaaagtttcaccgtgttggtatggtgacatcgttcctggatcaacgttaatgtatggatcaaacttttgtacggcaatcttgaagccgcggttcttcaacaagcgacccaatgatgctgcgacgatacccttacccaatgatgaaacaacaccaccagtaacaaagacgtacttagctgtcataaaaaacaatcctccgagttctgtttgcaggagcaataaaaaataaaaaagctcccaatgctattatagccttgggagcattaatcaactttgattacgtcttgtaaactaatacaagagcccggaacttaataatacaccaattccagaaattgtcaacttttagttataatttgttagtcatgatcggcaatgcgcatgctcttcttgaaccaaggagacgcaaagaaggcaatcaagtcatttcccatgtacaacatgtacgtgaagaacaataccaatgaggcatccccttgtgcggccgtaacaccccacaaaacaacttgcgcaattccttgcaagaaccacatgtagtaggcctctgagaaacgcaacgtcgtcaaaactgcccctgtgataccaatggctgctgccccagcatcaatcattgggcgtggtgagtgcgttacatagacatcaaagaagtaaagcgcaatgtaagaaatgataaataccagcacaaagaacgtacgggtctttgcaaaagtcatcttctcaccgcgttccttcacttcgctcagcttacgtacacgcgtcgcaacgttttctgaccacgatggcatcaaaataactggcaaatcaagcaaaataatataaacgaattgcaaaactgcatcggcaggattacccgcatctagggccaagccaatataaacaagcgctgaaaccaatcccaaaataccgttaattggtcgtgcatttgtaatcgcaagcgtcgtggtaaagcccaacaacgctgcagctaatgtccaaattgccattcccgtaattggattagcaattgtttgactaatcaaaaagccaaaaccaaacatcagcaacaagtaagatggcaaagcccatcctctcatttgctcaacataccaagatggcttaaaaatctttgcaacgtgcgcccaagaaaacgatggcgtcttttgtggttcattcatcatgaaaacctctttcttcagtttactttattacgcgaggactctctcgcggttactaataaaaagcaactgtaccagtgtacgctagttttataaggtttgcaaaaacgtttcacccatttgggataattaataaatttgcttctcaaaaatcgccatcatcttctttgttgcggtgtgcaaaaagatatcgtactcagcgaacgatggcgacgacggccatacgaacaatgtggtttcatcagacatcgtcaagtgatccgcgataacgatatctggcgtttcttcgccatccgttacgaagacaacatttaacatttcggtggtcataatcatccgttgaatatgttgcgccaacaaattgtcttgataatctaggcgaacatgaatcgttggcaacattttttcacgtggcagcgcctgcaaaaaagcgttataaaagtcagtttccatgcgtcgcaaaatcgtgtcggtctgttcatcgaatgataaaccaacgtggcgaagcaccttttgcgtgaataatttatatgtcggataaagcgtgtgcccagtggccatgccatcctccgcttgataattaatgcgacgcaaaaacatcaacacgacaactggctgaatcaacaataatggccagctgcttttttgactctccggcaaagcctcaccgaaaaattcgcggtaggtggttgcaacgtttccaaagaccgtctcatacatatctcgcaatgctggcgttgcatgatccatcatatttccgtgcaaaatcgcatcagtcattaaaacgcccattgcaaaatttgcttctgcgtctaagcactccggcattaatcgacgatagcgcagaacaatggcacgtaacgtgcgatatggcatcttcaactcgtcgtcatgcccaatcgttgattcaaaaatattactaatcgcttcatttttatcaatcgtccggcttgattgtagtcgcgtaatccagacgcccaaaaagacaaacaatcgaattcgttgtacgttgttcaaactcacaacatggtttccttcgaaaaaggcaactgtttgacgcgttaatactagaatgtgctctgggaaatagcgcgccaagtcagcttctgattcgacgatatcggctaacacgcggtacatcataatccgaattgtcgactcgttccccgtcaattgcatattatgaccgagcgaaacgccactgccaaccaaccgttcattaagcagtacacggtcagcagccaaatggttcgtcgcaatatcaaggcgctccgccatcgtcgctgatgacaccggctcgcctgatattccttgtacaagcatcgctaatgcatgggattcaattgtgtaaaaatactccaagcgcatgatgtttacttgataacctggcgtccacgaaatcaagccacctttttcttcaaacttcagcgccgcagtattcacaatcccaaaacgggtttcgtcgctaacgatttcgttcaacaaagtctttgccatatatttcgaaacattaaaacgacgctctacctcttgcaatggcacgcttgtcttattttgttgatataaaaagcgcacaacttgcagctttaggttttcgcgcttacccaatagccattccatgatcatcctccatctcaacccacaacagttttatcgtaaactcgtcaaatgattcccccatcacttggtcgtagtatggccaattttcttttggctggaaggtatgaaccatctcacgcactgtatcgtatttttgattggctagcattcgtttgcccgcaacaacaagtcgaatcactgtaattagctcgcgcaaaagcgaggtcatccaatcatctacttttaccggcatgctataaaaaatctcaactaactcatccatcaactgaccagcgccgtgctctgcttgcatcatgatcaattcaaacaggagcaggccaattacctgcgtcgcttcatgccggatagccccttgataatctcgactcatcgacatttgtaacctcacgctacgcaacaacttcttatactgttcccgcaaatcgtcataagaaaaataattcaagtacaacaaaacaactttcaactcagctaatgtatagctttcagttcgtcgtagtaaatccagtaagataggcttcaatcgcacgaccagctcttctggcaacgtcgccacagcccattggtcatccgattttgccagcgcgataatgtctgttaccgttcgtttttgttggtaactatcaattgcacgttgtaattgatcagacggcgtatccgctatctcttcgcgtggcatatacatgccgatttcagccagtcctacgttaagcgtctttagaatagcgtgcaacttatgaacggtgatatcaccttgtccattaataaacgtataataccgaccacttgaaatcgcggtatgttgcaacatatcacgcacagaaatatgcttcacatcaatcacttttcgaaccgcattcaaaatcggcgtatcaatccttgtcatactaaatttcctctccaaacctcagtcttgtttttgtctatgtcacttacattcgggaagtttaacacaagtatttttctcttcacttgataattttatataaagcgcgaaaaatagtatcacgtctggtttttttaaatttttcgaaaatgaatgcgttttcaatcgattttttgaaaaaaataaaaaagcgagcatcgctgctcgcttttttatcgatatttaattatcgctcgatgtcacctgaaccgtagtcatcatcgactggtgcaatgccacctatttcttcgccgataccaccagcaacttcgtcattaccgaaatcatctgatgaatcgtcatcatcgtcgtcatctgcatcatcatcatctgaatcagcagctgccgtctcgtcttcgtcttcaacttcaccgaagtcgtcgtcttcaggatcatcatcgttgtagtcgataacatcgtcatcatctgcaacgtctgccaaaaaggcgttgatcttcttacgcttcttcttctttggttgaccttcttcttcttcaagatccaagtgaacggcttcatcaattgagtcgattgggtaccatgaacgtagtccccacatgttatcacccaatgaaatgaatgaaccgtcaatattcaaatcagtgtagaattgtgccaagcgcgcacgaatctcttcatctgacttaccagtgaatgattgtacttcattcaacaagtcgttaaacgccatggtgtcatgacggtcagacaaaatcgcacgagcaacttcaatcattgaaagctcagccttattttggccgtcaaattgtgttaatgccaaatcactgcacgtcctttcgcggtcttactcaatgtcttatcttacaatatttcagccgtttcggcaaatgttattcttcgcaaattaagcgagttctggtacatcacgtcccaaaacccacttttcaacggcaacaccaacaccatccgcgttttgtgtcgtcgtttctacgtccgcaaccgccttcacttcaggaaccgcatttcccatcgcgacacctaatccagcagcctcaatcatcgtgacatcattttgttggtcaccgagggccatcgtttcagagcgatcaatacccaacttagccgccaacgtcaacaagccactccccttcgtcgcatccttgtgcatgaactctaagtgttgtggcgttgacttcacaatgtaatacgcttccttaacatcagctggcaatgcatcgcgccaactatcaatatcagcttcatccccaatgaacataaacttaacgtagtggtcgtttgggtccatttcatcaaccggcttaatgatcaatggcatcttaatcaaaaagttttcacggctagcccagtagttgatttccttagcagacgtataagctgcatcaatcgtctcaacttgcaagtaagcacctaactcatcagcaacctcgcgcaaacgtaggtaatctgagtacgctagttccttaccgccaagttcttcaccattagttgtttgcacaaccccaccattgtacgtgatggcatattgatcatcttggtgattcaatcccaattcatccaaatattcttggacacccggcaaagggcggccagtcgtcaagacaactttaacgccttgcgcagttgcttcttgtagcgcagccttcacacgaggtgtgacttgcttggccgtgttaactagtgtgtcatcaatatcaatcgtaatcaacttaattgccatatctgtattccccttacttttcagttggcttaaccaatgtttcgttgtgcacataacgttggaattctgcataaagcggtgccatcacgtcatcgaccgcttgcgtattcatcatctcacgtgggaagaagaaacgcgcatttccgaatatacggcccgtcatcgcagccaccagcgcactttgtgttgatagttcaaacaattccccagccggttgcatcatttcaatctgtgtacgaggcttcttatcgcttggattatacgcatcgtatggtaagtcataactgtcattttcagccgtgtaataacgctcgtcaaacccagctgacgcaatcaacttcgtaattgctggcaacaaatttcgggctgaatcttcaatcaaaattgacttcaacggcttacgatccaagaaacgcgtggccaaatctgccaagattgcatcatcagccaggcgccactcactaatattagctagcataaccgaatcgtctagcatcaagtattgttctagcgaaaagtcgccagcgaacaatggcatcaaagccggcgagataaagctcgttgaaatacgcgaatctgtcttactctcatcatacaagaactttgcacgctctagcaggtgctgcaacagcacttcaaacgaacgtgacactgggtggaaataaacctggacatacatttgataacgcgacaccacgtaatcttccacggcatacatccccttttgatcaaaggcaattccacccttgtatggacgcatcacgtgaatgatacgagctagatcaaattcaccataggtcgcacccgaataatatgcatcacgcaacaagtaatccattcggtcagcgtcaatttgacttgaaatcaactgcaccacttgtggattttcgtaggttttagcaataacactcgctaccttggccggaaaatcaggtgcgacctggcgcaaaacttgattaatttcagtttcgggcgacaaaataatttgttgggtgtacgactcatgatcagtattgaaaatgtgttcaaacgtgtgcgagtatgggccgtgacccaggtcgtgtagcaaagctgacgttagtagcaccaagcgctcgctagggtcccacaacccatcacccggctcctgagttggataaaacttttctagatggtcagcaaactgacgggcaatttcatatacacccagcgagtgtgaaaaacgtgagtgctcagcgccgtggaaaacagcactagccacgcccaattgcttaattcgtcgtagtcgttgaaactcagatgtgccaattaaatcaagaataacttgatcttggacacgaataaaattatgtaccgggtcacgaaagaccttttcctttacttctgtcgtcataagtcgaaccttgattccttccctatttccgaactactgattcgttacttacattataacctagaaatacctgtataatggaagtaataggcttattgaaggaggaaatttgtatggcaaattcagccaacggatatccagtaacattgaaattaactacggtcatccgtcaagaaggtgacgaagagaccttcacgttcgaagaatacggtacaatcaccccaatgggcgacacattatacctacgctacatcgaacaccaagccggcttagaaacgccggtaacctttaagatgacacccgccggtgaagtctcattaaagcgttctggtcaaagcgacgttcgtttgcaatttgcacctgacgctacgatcccaacgcgttacgtgacaccgcaaggatcaatgtcaatcgacgtacgtactaacgacttaaagactgtccttgatgaagattttggtcacgttaacgttgcctactcactactagctggtgagacgctactgggtgattattcgcttgaactccattttgaaaagtaacacgaaaaagcctcgccaatgcaaatgcatcagcgaggcttgttttttggcacaaaaaaagaccatcgtgcaagagggggaacgcaacgatggtccgtcgccggctactatcgcaaccagcgaggggggtgttacatactttggggaaatatgtaacgcttcatgtactttggggagtaatgaaatccactaggaacagcggatatgtataatatatctaatccgtgtgaacaacgtgtaaaaaaagtgtttcaattagttaacagaactaacaaatcataagttgagtgttgcaaaaaagagactacctaggtagtctcttccattttttctgactaattcgactcagatgatgatgttaatgagctcgttgtctttgttaacttagcatcaacggtcttttctttaccatcgcggtaataagaaatcttaatggtatcgcccaccttgtgcttgtacaaggcatcacgcaaatcaccagatcctgcgatttcagtatcgtcaatcttagtaataacgtcgtatttcttcaaaccggcttcagcagctgctgacccatcagttgtccccatcaccacaacaccaccagaaacactggttggcaacttcaagacgcttgattgatcagatgttgaaacattactcaaatcaaccatcgtgacgccaagtgctggacgttctaccttaccattcttttccaattcgttaatgatgcttacaactgtatctgaaggaattgagaagcccatcccttcaacagatgtcccgtctgatgatgaagccaacttcattgaattaataccaacaacttggccggctaggttaaccaacggtccaccagaattaccagggttaatcgccgcgtcagtttgaataacggttgccttaccaagagaattaccactctcatccgtcgcatcaacttcacgctttgtcgctgaaataataccttcagttactgacgttgcatattcagaacctaatggtgagccaatagccaacaccgcttgaccaggttcaatctttgatgaatcagcaaagtccgccacttctgacaccttagctgagtcaatcttcaacacagccaaatcagtttgctcatcagttccaaccaaggttgccgtcaatttcgtaccgtcacttagcaagacttgcaacgcatttgagccagcaaccacgtgattattcgtcacaatgtaggctgtgccaccctgcttcttgtaaataacaccagatccttcagaagctgtttgcaaatctgaagagtcactattcttacttgaactattaccgtagtcactcgtcaaaccaccaaacattgaatcacccaatgattgttgcttttgtaagttgataactgatacaaccgcgcccgaaactttgttaaaggccttcgttgcgtcagatgttcccttcacatttgagttgctaactttaactggtgttgtcttaccagtcgtcaccgctgatggcgccagcatacctgagttgttcaagtaggcaacaccccctgctgccgcaccacctccgaccaaaccagcgaccaaaccaacaatcgccactttcatcgttgctgacttgctaccactacgcttttcattttcagtcatgggtaacccctccatattatctctgattatttactcatattgtaacggctatccctttaagtcgccttaagaaaactcttttaaatgtccaataacttcgttgcctgagctggatcggtatcaaatagattaaaatcatggcctaccccaaagtcatgttcttccaaaactgactgcaccgttaaatgggccaacggcttttggttattctcttgactcaagtgtcctaagaaaacattcttcgtgcggtcccccaagatctcagtcaacgccaatgccccatcttcattagataagtgaccttgatcacttaagatgcgttgcttcaaattccaagcatatccgcccatacgaagcatctcataatcgtgatttgcttccatcaagactgcatctgcgttacgaatcgtaccaacaatgcgatcattaacataacccgtatctgttagcatcgcaaacgtcttattgtcgtggtggaaagcataaaattgtggatccgctgcatcgtgggaaacactgaaactctcgacgtccaaatcaccaaacagcttcgtctgaccagcttcgagaatattcatctgttcaggtttgattttaccaattttgcctgccattgcatcccacgttttcgcattcgcatagacatcaaagccatacttgcgtgccaacacaccaacccctgcaatgtggtcactgtgttcgtgtgtcacaaacaacgcgtcgacatcggacaatgaacgaccgatttgattcatcagtccatctatctttttccccgacaaaccagcgtcaaccagcaccttgtgtgtcggcgtttcaatgaacgtaacgttacccttactgccagaggccaacattgacacatgaaaatcacttgccatttctgccatccccattctttttattatctacaaagtaaaaacgccgtatgacaaaagagtcacacggcgtttcgtcgttatctattttaacacgtcattatttcattaatgcgccattcaacgcattgattcgtaataacgtcgtgttaccagtaccgtccgtcaccgaaaagatccatgctggtacaaaaatcgtatcatcaccgaccgtcgtcaacggcgcgtagcccatatgactccaattcaacttaccattatttggaatttcattatattgataagcaccaatcaacgctttttcttccgaaatcagcgtcgtcgagtcacgcaacacttgtgcattcgacacatacgtctgtgtgtagcccttcaaatcatgattcttatccaacaagaatctaatttgagcacgcgatgtcataaattggcgtcggttcgtcattttctgtgtatagacaaccatcgctgaattatccgaatcattattcgcatactccgtcaatttcgcatcgtacacgtattgcgttcctgcgataacctgcgttttgtcattgactaatttttgtaatgacttacgcacgtctgaacgcgacgtccccataaacactggtttatctagcgttgccgtcaattgattaccagttagtttagtagaccatcgcttatctaaactgtccatattggccttcaaaaagtcgttaccgtcttggccaccaatataggcacctgtttcagaatcggtatctaagttacctacctggataccatcgctcttcatctctgacaaaatactttctgtcgccgttggattagctgttggttgatggatttgaaaccactgaaaagccaaaaagacatcgatagccacaaaaaccactaagaaagtcgctaagatttttttgaaatccatcagttcgttcctccttgattttcagctaacttgtcattaacagcttgccaggtgctgccaacttcaaagtaccactcaggttgcaacgtcacaatgttttgatttgtatctgacacccaacgataaccataagccatattcgtaatcgactgttttgacacaccagcgtcagccaattgcttaatcacttcatccgacgttggcaatgtcacacggacattattatccgccggcaaaggcacttgcaatgaatactgtgaaaaatcaatttcttggtggcgactatcatgttgcttcatttgaaccgtaccataagcagtttggttgaaaatcggcaacccattaacataaagacgataaatcaagtgccgtcccatatcatgactttcaaaaaagtagatattatccggaatttggtgaattcgaacaagccaatcgtatcctttggccatgcgttgattaaatgtcttacccaagtcagagacatcataagcatcatacttcgcgacaccagaaacggtatccactgtcatttgacgagatacaccatcattataagtcagaacattgccattacgatttgcacttggcgtcgtcgttcccgcaaagagcgctgacagataattatttgtcgcattcgtttccattaagtagctgtacgaacgcaatgagacggtttcaagcgcatcagttagcacacgcttaccgttaatctcgaacttaactttcacccgttcgtcactcattttgaaactagcaaatgactttggcgcatttttaatcgtgtactgataaatcgtccgatgcttgtcgtccatgaacactaaagcgtccttgcccttttgcggcacacgaatacgatttatttcaacattgcttggtaaatcaacatcatttgccaaaatttgattaactacaccgccagcaaccgcatccggaaaacttatcatgaccgtgcctttttttgataaagcatcaagataagctgccttcgttagcttttgcttcgtgtaatcaccgacttcccaggtcgctaaacgcttaaccattttcgtcgtcgttgggcgatagtcaatgattgaatattgcacattatcttcgttgtacaccagttgatcaaagccataaaggtcggttagcgactttgaagcaacgacttgctgagttgcatctgcgtttcttttatcgcggttcaagtcgcgaccagggctgcgccataagctaaccgacagtgcgatactaacaccaattgccagaatcagcatcgctaccaaaccgaaacgacgaaataacactttgaaacgataatgtagtcgattaatcatcccattcaccatcatcccactcgtcttctgccggatcatacgcttcataaggcaatgaaattgagaacgttgaacccttaccttctgaagaatctacccaaatcttaccgccaaagcgttcgataatttccttagaaatagcaagccccaatccagttccaccttgggcacgtgaacgcgccttatcaacacggaagaaacggtcgaaaatgtgacccaagtctttctttggaattcccaatccttggtcggtaatgcttagtacaacttcagtcttacgatcaatcatgcgggccgtaatgacaccaccatcaggtgaatacttaatggcattgttcataatgttatccactacctgggtgaatttagacgtatccaactcaacccaaatttgcgaattcgtaatctcacgcttgattgtgtagtacttttcaggcttatcatcattcgcgatgatcatatcgaaacggttcaaaatgtaattgaacaattcgccaacgttaacatattccgtctccaacttcatcgttccagagtccatacgagacagctcaagcaaatcgttaatcatgtgaatcatacgagttgtttcgtcttgggcgaccgctaagaaactctttgcaacttcagggtcctcaatcgcgccttcttgcaaggcatcaacatatgacttcacagaagttaacggtgtacgcaactcgtgcgaaacattcgaaacgaattggcgacgctcttcttcaatacgttgttgctcggtaacgtcgtgtagcacgatgaccaaaccagaaatgaatcccgaagcgcgttgaatcaaactgaagtacgcacggataatcaattgacgttcttcattactgaaatcaagcaacaattcatcctgattatcaagcaactcacgcaagttatagcgatcggcaatctgcaaaacttccaaaatcgactgacccaaggccacgttactatcttccatacccgtcatttgcaacgcagccgtattaataatgttaatacttccgcgacggtcagtagcaataacaccatctgtcatgtgttccagcactgaatccaaacgacggcgttcaaactcagtcgagttcgtcgtctcttcaattcgaactgccagtgcgttaacattttcagccaattgtccgatttcatcattagaacggaccaaaatgccgcctgagtaatccccttgcgcaatttgcgtcgtacgatcgttaatttccgcaatcggctttgtcaaactacgtgaaataatcacggccatgacaacacccaagaccacggctaacaacgatgctgagaagtaaatcagcgaaatgtgattcaaattgtcataagttgtttcaaggcttgctcgcacttcaacaactccaatgatgttactctcaccaccggatgaactcaccaatggctttacgacaacttggtaacgaacacccgaacgttcttcaattgggttctttgtgtactttccgcctgccaacgccgctttgacgttagcatccgttgttttttgcccaacttcatcttgggaattaatatcactcgtaccgcgaataatacctgatgaatcaatgacctcaatctctgaaattgaggcattattaattgacgtcagaatcgtgtggatatcgctattcgccttcgtttgatctgtgctgattaattgctgcgttagcgaatcattcacataagccggcaacgcaatttgtgttctaaacgtcgccagattttgttgttccaaacgtttaacgaagaacgctccaaccagttccaacgttactagtagcgtcagtgtaaaaaccaacgcaattttaaaatggattgaagaaaaaaacttccgccaccttttttgctctgtcaattcttcaaaatctgccatcgcgtttttaattctcccaaatttaattaaaaaaatagtgccatgccaatcggcacggcactaaccagtctgctttattcttctgaagccttcaaatagtaaccgacaccgcgacgtgtcatcaaaatttgtgggtgacttggtgtttcttcaatcttttcacgaatacgacgtaccgtcacatcgaccgtacgaacatccccaaagtaatcgtaaccccaaaccgtttgcaacaaatcgtcacgcgtcataacttgaccaatgtgcttagccaagtggtgcaacaattcaaactcacggtgtgtcaattcaatatcttgaccgttcttagataccatatatgcatcagggtgaatcgttagggcaccaatcttgatgtccccgctatcatccataacattttgaccggcaactggcgcttggcggcgcaagttagccttgatacgtgccaacaattctcgatttgagaatggctttgtcacataatcatcagcccccatttcaagtcccaaaaccttatcgatttctgagtccttggccgttaccatgataacgggtgtttgtgacttcgttcgaatttgacgcaacacttctgttccttcaagttcaggcaacatttggtctagcaaaactaaatcaggctcttcactctcaaaaagatccaacgcttcttgaccgtccatggccacgacaacgtcgtatccttcctttgtcaaattaaacttgataatatctgaaattggcttttcgtcatcgacgactaaaattttactcatctgttctttatcctcccagtggcgggtatcttgtaactattatagcatgttacaaagttttcgtaatctttcagaaacagaaaacatttattttacaaaaaagggttgcaaaacattcatatacttgttattatattatctgttgttgaggcaacgaagaaaattatgggcagatagctcagttggtagagcaacggactcttaatccgtgggtccagggttcgagcccctgtctgcccatcccatagccgctagatcatttgatctagcggttttctttttgtccatgccgataaatttatctccgtcatgaaaaaagcgctttttgttcaaaaaagtgttgcattcattttcagatggtggtatattaatatctgttgttgagagacacaaagagaattacatgggcagatagctcagttggtagagcaacggactcttaatccgtgggtccagggttcgagcccctgtctgcccatcccataaccaccaggtcgtttgatctggtggttttctttttgctttttcgcctagttaccacactaaatcacgtgatgccgcttttttgaaacttttttcaaacaaaacacttgcacagcactgaaaattctggtatattagtatctgttgttgaggcaacaaagaaaattatgggcagatagctcagttggtagagcaacggactcttaatccgtgggtccagggttcgagcccctgtctgcccatcccataaccgctaggtcattgacctggcggttttctttttgcctttttatcacagctgctgctggtctaaaacttccgacattctcagtctgctttatcgcacgatcgtagtagctaacaaactcaccaaagatagtttcaacctatttaccccatctccgtcctcactctattttagaatcacttttttcaaacaaaacacttgcacacttactaattatctggtattattaattctgttgttgaggcaacgaagaaaattatgggcagatagctcagttggtagagcaacggactcttaatccgtgggtccagggttcgagcccctgtctgcccatcccataaccaccaggtcatttgatctggtggttttctttttgcacaaacacaaaagccggttcgcatcactttgcggaccggctttaatttacttagctgcagcaatcttctcatcgaagttcaacgtcaacaaacctaaatcaatcaatgattcgatttgatcttcattcgcttcacctgggaactttgcttccaattcattttgatacgtctcgacatatgtatcttcaaacgcatcgcgaatatcttcagctgaacccgtcttgataatgccgtccttttggtcagcgataaacttatccaggtcccccttcagacgatcaacaacctcttgctccgatggcaacgccactgatgtcgtcgttcccgccgcgcctgaagatgacacagcagaactcgttgacgaagacttagcaatcgattctgaatacgaacgtgcaacacttgattcgtattgacgctcaaatttttcctcttgatgctcattgtacatattcataccaaccgcacctaaaattagcgctacaactgccactacaccgctaataagccatttcttcataagtatgttcctttcccttgtttgtccaaagaataccgcacaaacgtgtcagaaaagccgtcaaaacataaaaaaagagtgaaccagcaatgctgattcactcttttaaaggttgttactaaaagcgtatgctattagtcttctgcaacgaatggcaaaagacccataacacgtgcacgcttgatagcagtcgtcaccttacgttggttcttagcagacgtacccgtcacacgacgaggcaagatcttaccgcgttctgagatgaaacgctccaacaattcagtgtccttgtaatccacgtattcgatgtggttggctgcgataaagtcaaccttacgacgacggcgagggccgccaccacgacgttgttgtgccatgattaattcctcctgatagacttatgtcgttagacaattagatatatcaacttagaatggtagatcatcgtcagagatatcaacctcttgaccaccaccgaaaggatcatttgatggttgtgaaggttggctaccaccaaacacattaccatttgatgatgaagaaccaccgaatgggttttgtgctggcgcggcattaaagccaccttggttgccaccttgttgaccaccgccgaagttgttgcttgcaccaccgttttgtgaacggcgttgttcgctttcagctcgactctccaacaatgagaagttatcaacgacaacttccgttacataaacacgttggccttgttggttctcgtagttacgagtttgcaagcggccttcaactgccaccaatgaccccttagaggtaaagttagcaaagttttcagccgacttacgccagataacggcgttaataaagtcggtctcacgctcaccattagcgttagtaaactgacggttaacagctagtgagaaagttccgacagcagcacctgaagtcgtgtaacgcaattcaacgtcacgcgtcaagcgaccaaccagaacaacacgattaatcatatggaaagtctcctttcaatcggtcttaatgacctgcaactaagttaataaaaaatgttagacaattaagctaacaattactcagctgatgcaaagtcgcgctttacaaccatgtgacgcaagatatcttgtgagatctttgccaaacgatcaaattcgttgatggctgcgtcatcttctgcagtaaagttaacgatgtggtaagtaccctcacggtaacctgcaatttcgtatgcaaaacgacgtgatgaccagtccttagactctgccaccgttgcaccgttgtccgccaagatcttgtcgaaacgctcaaccaatgccttcttagcatcagcgtccatgtcagggcgaatgatgtacgtcaattcgtatgccataataacttcctccttttggtctatggccgacttcctgccggcaaggagagctgttgaaatttaattcaacataactcacaagaactaagtttacacgcgatacaaacgttttgcaagtgaaatatccattacaaattcacgtcataccacgtgtcatacgctttcatgcctatcttacttaggaactaaacctctcaacaaatagcaaaaaagcacgactttcatcgtgcttagttagcttacttaaacaatgctgtcgtgtagttcatgaagcgttccaaatagaatggttcatcaactgcaacggctgcgaagttattcttgtgtggatcacgcaaacgagatgggtcaccaatcgtgcgaccatcttcaggcgtaaccatcatgttcaatggcaacaacgtcaccaagttagggtcaacagcgacaccaactgcaagtgggtcgtgcaaagccgccccagccttgttgatatccaagttgtaataagcgtcaatgtagtaatcgaaaatatccgcgaatacgcgacccttttcagttcccaaatcacgccatacttgcgtttccttcttcgtcaaaagcgtttgcaatgtgacatccaagccgaccattacaaggtgcttagcgtgcttaaagacatagtcagccgcttctgggtcttggttaatattcgcctcagtatatggcgttacgtttccaggtacaacaagcgccccacccatcaacgtcacattaccaatcaagttttcgatttcaggatccttttggtaagcttccgccaagttagtcaatggaccagttggcacgatgaccaaatcatcagcatacttgtgagccgcttcaatgatgaagtcaactgccgtttgcgcttcaactgagcgacttggtgttggcaattcaacatccccaataccattcttaccgtggatatccattgacacttgcatcgtttcaaagttatcagtcgttgatgagtgcgctgcaccaataaagaccggtacatcttcgcgtcccaacaactcaagcaacttcaacgtgttttcaccagccgtgttaacttgcgtgttaccaaatgatgaaacaaccccaatcaaatctgaatctggcgttgccaaagcgtatgccaacgccaaagcgtcgtcaacaccagtgtccaaatccaaaatcatcttcttctttgccattagaatatcccttctttatagaaaaagcactgccctaaattagtattagaacaatgctttaaaaactcaaattcggttagtcgaccgtacggtggaaacggttcttaaacaatggagataccgcttggttctcattgatacgcttaatcgcttcaccaatcaattctgcagtcgtcacttgcaccaacttagggaacttcttctcttcaggcaagttaattgagtcagttacgataaccttctcaaagactgagttttgcaagttgtcgacagctggacctgagaagaccgcgtgtgttgccacaacgtaaacttcagcagctccttcatccttcaacttttgtgcaccttgtgaaatcgttccaccagtgtcaatcatgtcatcaatcatgattgcgcgcttacccttaacatcaccgatgatgttcatgatttgcgccacgttcgccttaggacgacgcttgtcaataattgcgataggttcttgtgaacccaacaattcagccaatgcacgtgcacgcgttacaccaccgtgatcaggtgacacaacaactgtgttgtcatcagcaataccagacgtgattaggtagtcagccaacaaaggcgctcccatcatgtggtcaacaggaatgtcaaagaatccttggatttgcgcagcgtgcaagtccaaaaccaagacacgcgttgcaccaaccatctcaagcatgttggctaccaacttagctgagataggttcgcgtgaacgagccttacgatcttgacgggcgtaaccatagtaaggcataaccacgttgattgactttgcacttgcacggcgcaaagcgtcaatcataatcatcaactccatcaagctatcgttaacgggtgctgacgttggttggataacgtaaacgttatcaccacgtactgactcttcgatattgatttggatttcaccgtcactaaatcgtgcaatgttaatttgtgacaattccacgccaattgaagcggcaatcttttctgccaaaggctgattgctgctcaatgaaaaaatcttcaaatgcggatccgcatacgtcgccatgttgtcctccatagacacatcactgtgttcctcaagtgttcaatagttacattgtaccgtttttttgtatattcttcaacgaatacgccgttcagatttccgaacactttcatattctcttcgaatttcgttaacgaaaaaagcgacaccacaaacatggcatcgctttcattaatcattacttaatttcaaaaaaggcatcccaagcagccttagcatcgcgcttcgctgattcggtatcatcaaacttttcgtgcaatggcgtacggttccagaagtcatacttcgtcacttgacgcgtacgagcaattcccatcgcgtgcgttggcacatcatcagtaatcgttgagccagccgcaatcaaggcttcactaccaatgttaaccggtccaacaatcttagagtttgacccgataaaggcacggtcaccaacattcgagtgccacttgtgcaaaccatcgtagttaacaaagattgaaccagcaccgatgttaacatccttaccaattgtcgcatcacctaggtatgacaagtgtcccatcttagaacccttacccaagtgcgccttcttaacttcagtaaagttaccggcgtgcgcttcaacatccaagtaagcagctggacgcaagtgcgcaaacggaccaaccgttgcgcgctcacgaatttcggcttcttcaaagtgtgatgcatccacttgggctccatcagccacaattgaatcaaccaaacgtgagcccgtcgtaatcaaaacgtttgatccgatttgcgtcttacccttcaagtaaacgttaggctcaataacagtatcgttaccaatcgtgacatcaacatcaatgtacgtgttcgctgggtcaatcaacgttaccccgttacgcatgtgcatttcgttgacgcggtcgcgcaaaaccttgttcgcacgggccaaagcaacacggtcgttaacacccattgattcgtcaaagtcgtccatcacaaacgcaccaaccgtgtgaccttcgttgcgcaaaatctccaacgtatctggcaagtagtattcaccttgcgcattgtcattcgtcacttgcttcaaactgctgaacaacaattggttgtcaaatacataaacacccgtgttgatttcatttacggcagcttcttctggcgtagcatccttttgctcaacgatgcggataacattacagttttcatcacgaataatgcgaccgtatccagttggatcaggtgcaatcgccgtcaaaacagtcactgcgttacctgattgctcgtggaaatcaaacaacttgttaaacgtattaaccgtgaacaaaggcgcatccccagaaccaatcaacgtcattccttcggcgtcacctagttgtggctcagccatttggatagcatgtcccgttccaagttgttcagcttgcaacgcaaactctgatcgaccagccaaaacagcttcaacacgctcagctccgtgaccaaccaccgtaacaatcttttcagcaccagctgcttgagacgtttccaaaaccatctcaaccattggcttaccgccgacttcgtgtagcaccttaggtaggtcagacttcatacgagtccccttaccagccgctaaaataatgacaaaacgttgcatctttctttctccacaaataaaactttaatcagcagaagtggcgtcagcaggtgatccaccaccgtaaatttcttcagcgtagtttcctggcttcaccttgataatgccgtcatccttgttggtatcaacgtgtaccaaagatgtgtacttatcaatgacgcggtgttcaacgcgaccttcagccacgacagcaacaccgacaacctggccttcaaattccttaaccaaagaagccattcctcgaattgtaccaccagccttcatgaaatcgtcgacaataaggacacgagatcccattggcaatgaacggcgtgacaattccatcttctcaagacgttgtgattgaccagtaacatagttaactgacatcgttggtccttcggtaaccttagtatcgttacggacgattacaaatggcacattcaacttttcagcaacggcttgtgcaactggcacacccttagtagcagccgtcataacagcgtcaattggctcacgcaagtattgcgtggcaatcaaacgaccgatgcgttgcaagaaccaaggttgtcccaacaaatctgacaagtaaacataaccaccaggcaagacacgtgtctcgtcatcaatggcgtttaccaaagaagcaacaaattcttccgcttcagtttcaagcatgtatggcgtaaagcgtgcaccaccagcagcacccggaatcgtctccaatagaccaataccgcgctcttggaaagtgcgcttcaaaatcgtcaagtcttcagaaattgatgacttggcgctctcatataattctgcaaattgtgtcaaagacaccaacgtacgtgggcgctccaataagtagcgcgtcatatcgaccaagcgatcactgcgtcgtgttttcatatctcattaaacctcgaacgttcggtaatttttattattatgacttaattataacacgttcgttcatgtaaaaactcgaaaataggtttaaaaccgaaattacaaaaaaatcacgtgggttttccacgtgattttcggacgttcggctttttaagttaaccgtttaactaattattgccaagaaattgttcgttcctcaccatcaactcgagcacccaaagccaattcattaatctcgggttgatcaaatacaggtagcatctcagcaaacgtattcggcaacacataacgtccatcgagcagcttttcacgcgtcgtccagaagatttcaccttcccgacctgagtgaatcgttcctgaatactcagttgccttgtacaaaaagacaatatagcgcgcaccattgtctagtggccattccttaatgcccatcaattgtgggttcgcaatttccaaaccagtttcttcacgcgcttcacgaaagacagactgcgtcaccgtttccccgacttcaacgtgaccacccgggaacgtcacgccgggccactttggatttttgcggtcttcaaccaatacctcatgagtctctggattctcaatcataatcatattcgttaattcaatcggtgtgtatcgatctgccattactactcactcctttttgtgacaaaaacagctcagctgacaaatgccaactgagctgttacaaaatccatttttagcgaattagcccttgaagacccattcgttgccatccttggccaacaaatcgtttgatgcttctggtcccattgaacctgaaacatagttagggaattgctcacgcgttgcatcccaagcttcttggattgcatcaacgaacttccaagcaattgccacaccgttccagtcggcaaagtttgaaccgttaccgtccatagcgtcgtgaatcatacgctcgtaaggctctggcgtcaacttcttgtcttcgtctgaaaccgtccagttcaagttaacaacacgcgtcaagaattctgacgtcacatccttagcgttaatcttgaactcgataccaccctttggatcaatcaaaatcgtcaacacagggttagccaattcaacgtcaccgccgaagatgttcaagcccttcttgaagacaacatcgacacgcgttgacttagcggccaaacgctttcctgaacggatgtagaatggcacgccttcccaacgatccatctcgaattgcaacttaccagccacaaacgtgttgttttgtgaatctgctggcacgtccatttcgtccaagtacttcttttgtgtaccatcggctgactcgccgtattggccacgtatgaagttctcggcaacctcttcacggttgtaaatcttcaatgagttaaaggctgcgttcttggcagcacggatatcaacgtccttaaatgacgctggcttttccatggccaaccaaccaacgatttgcatcgtgtggttttgaatcatatcacgcaaagcaccagccgtatcgtagtatccggcacgctcttcaacacccaaaacttctgacaaagtcacttggatgttttcgatgtagtccttgttccatgcagcgtcaaacaatgggttaccaaagcggacagcagcaatgttttgaaccatttccttacctaggtagtggtcaatacggaagatttgggcatcttcaaaggcttctgacaattcgttttgcaactcttcggcagtaccaaatgatgttccaaatggcttttcaatcatcaaacggttgtactcaccgttttcagtaatcaaaccttctgacttcaagtacttagcaaccgttccgaagaaacgtggggcaactgacatgtagaaaatgcggttacccttcaagctgtacttggcgtccaattcgttgttcaagtccaacatagcagcataaccgtttgcatcagtgatgtcttgttggatgtagtagaagtgagaaatgaattcttcagcatttgcttgatcttcaacgaagtcagcaattgattcgcgaaccatttcgtggaactcttcagtcgtcaactcttgacgggccgtaccgataacggcaaagtgctcttgcaagaaccccttcttaaacaagttgtacgttgatgggtacaacttacgcttagccaagtctccagttccaccgaagaatgtcaacaatgttgtaatttctgcaggcacgatgaatgctcctttactctcaaaaaatcgaaataatcattagcttataagttcaaatcagtaacagtatctcacactcttactcaataaccacattataaacttttttacagcgttttgccacaaaaatgtaaaacgcttacattaaaaacttatgacatacattttatatgcttaaccctcagaaaagtatcgcgttgcagcgattgcattatgccatccattcaaaagggtttcgcgacgttctgccggtaatgatacatcaaaatgacgaccacgttgaatgtattgggccaggtctgacaggttctgccagtacccaaccgctaagccggccaagaacgctgcaccaagcggtgttgtatcttcgtcaattgaacgctcgattccaatgttggcaatgtcggcttggaattgcatcaagtatggattgcgtgacaccgttccatcggccttcatcttaacgacatcatacttagattcagctttcataatggccaaaatatcagccgtttgatacgcgattgactgcaacgttgccttcacaaaatcagccttatctgtgccacgtgtcataccgaacactgccccacgaacttgtggatcccaatagggcgcccccaatccgttaaaggccggcaccacatacacctcatcattattttgtgactgctcagcaagttgccaggcatccaattgcgtttcaattaagcccaaacggtcatgcagccattgcaccgccgatcctgctgagaagatggcaccttccaaagcgtaggttggttcatcaccaacttggtaggcaatggttgtcaccagttgattttgtgaggtcactggctccttaccggtattcatcagtaagaaagcacccgcaccatacgtgttcttaattgtgcctggctcaagcgctagttgcccaactagtgatgcgttttggtcaccgatgacgctggcgactggcacacggccaccaaagaattgcatcggattcgtctgcgcaatcacttcactgctggtgtgaacagttggcaacatgctttctggaatattgaacaactgcaacagctcttcatcccaagcttgtgtgtgaatgttataaagcatcgttcgtgacgcattacttgcatccgtggcatgtgtttcaccatccgttaattgccaaagcaaccatgtatcgacagtcccaaagacaagctcccccgcttcagctcgttcttgtgccccggcaacgtggtctagaatccaacgaatcttagttgctgagaagtacgcactgattggcaatcccgtcttctcacgaatcatctcagcacgcccggcattattgagcgcatccgcaatggattgtgattgtgttgatgaccaactaatcgcgttgtaaatcggttgccccgtttgtcggtcccagataatcgttgtttcacgttggttcgcaatcccgattgccttgacttcatcgccacgaattccagcattaatcaacgcatccgcaatggccgtctgcgcagtacgccaaatatccatcggacgttgttctaaccagccagtgtgcggcacgattggtgtcatttgcactgctgttgatgtcacgcgacgcgcattgtgattgaaaataactgcacgggtccccgtcgtgccctgatcaatcgctaaaatgtattcaggtcgtgtaatagccataagctttccccaattttttcgtttaaaataatttcatcctctcttagtataacaagttgttagaatgtgctacacttttctgcataagatatacgatttagacatgtcatcaggcatgtcggatggaggatttatgtcaatctcgtcagcggatggcgaagtgctcaaaccgaagcacgtagaaattaaggccccaattctttatataacaaccctcttccagtcaactggtgcatcgctaatttggcctatcgccacgttatacatgcacaatgtgttgcacgagacaatgaccatggccggcttagtcgtcatgggcctatcaatcatgatgatgattggtagttgggttggtggacacctatttgataaatggagtcccttcaaatcaatcgctagtgccgttgcccttgcaacgacaatgttagccttgctaacgttctggcactcatggccggtattcgcagtatttatgctaatacttggtttcgccgacggtatcatctacaccttgttaaattcatacgccgctacaattcagtcgctggattcacgccgtgtgtttaacatgcagtacctatttatgaacgtcggtgtcgtggttggaactgccattgttggtttccttttcaatcatggtgtgcaatacgtcttcggtggcgcaaccttcatgtacgcgattttcttcgtgctagtgctccgccacttcaacgtgaagggtatgaccgcacaagcctcaaaggaagctgctaaggctgccaagagtaacttcaagacgccggttttgatttatgccttgcttggtttggcattctccctttatatgggatacattctgtgggagaccgtcgtggcaacgcacatgaccgacctcggcatgacgacacaagactattcattcctatggacattgaatggtatcgtcatcattgtcggacaaggtttgctggatcgcatcattgaaaagttgccattccgccttaccgtgcttggtggaaccgccttattcgcgatttcattcatcttcttgatgggtgccaagacttatccaatgttcatcttcacctttatgattttgaccattggtgagatgtttgcgagtccacagatgccagcttggattgatgatattagtgatccaaatgctaagggtcgctcacaaggtatgatgaccatggcgatttcacttggccgtgccgtcggaccgctatacggaggtttgatgattgacggtggttcatacaaagcgttgttcgggtcaatgtttggtatcatgatgcttttcgtcatcatcaccttcatcctcgaccgcgctttccgcgcccgcaagcgccgtttaaataattaacctttgcaagcacctcaatttcggttgaggtgcttttttacgcaaaaaataaccgccacatatctgcgacggttattagtagctctggcttttgtaagcttttaggagcatcgttgttaatttgattcacagccagaatgtcccctctcacgtgggacgttattctgctgtgactatcttacaaactcttgaaatcgaagaccatacgtcccgtgatttggttgttgtgcattgcttcgataacatcgttaatgtcacgcacatcagcacgcgtcacgattggcttaaccttaccttcagcaccgaattggaaggcttccttcaagtcttcacgcgttccaaccaatgaacccttcacttcgataccatccaaaacagtcttcacaacgttcaattgcatgtcaccctttggcaaagcaacagcaaccaacttacccattggacgtagtgaggcgattgattggtcaaaggcttgggtgttaacggccgtaacttgggcgttgtgcacaccaccaaccttttcttggatgatggctggcacgtcttccgtcttacggttgatcaacaactcagcccccatcttctcggcggctgccaacttgtctggatttccatcaacggcaacaacgtgtgcaccgaagacattgtgggcgtattggatggccaagtttccaagaccaccagcaccaacaactgaaacccattgaccaggcttcgtctcaccaaccttcaatgacttgtacattgtgacaccggcacaagtgattgatgaggcttccattggatccaaaccttctggcaccttaacagcgtacttggcattaacaacaacttgttgcgccatggcaccgtcaactgagaaaccagcgttacggaccttgcggcagaacgtttcatttccagtgttgcagtactcacagtttccacatgcgtcgtagaaccaagcgattgaaacacggtcaccaagcttcaaaaagtctgaagcaccttcaccaagcttcgtgacaattccaactccttcgtgtccgattacacggcggaatggacgtgggttaatttcgtttgggttgccaaaatcaccagcggcaacgtgcaaatcagtgtggcaaagaccactgtattcgacgtcaaccaaagcttctccaaagcccaaagcgcgtggctcccaatcatcaatcaagtctacaaatccgtctaggttctcacgtacgacagctgctttcatttcaataatctcctcaaaatcgcaaattgttacttacttcacagtttgtattgtaaaatacttcacaatgttatgcaagcgctttcttgaataaaaataagaaatgggacaacaaaaaaagcgtcctcccaaatggcggacgcgtttctaatttttaatccaatgtaataatcttttcggcgctaaatgcatagataaaacgacgtggcattggcttgcccatcgcaacaagtgcttgcgcatagatgtttagctgaccagagtagcggctcgttagcgtttccgctgcgtcctccggcgtgacacgatcagtcttgtaatcgaataaccagacctcaccatcaacttcgaagtaaccgtcaataattccgtggaccagtaccttctcatccccttggaaccccttgtacaaacggctagcatccaacagcaatgagaattgcacttcacgttccaatgaatcagcatgcattaccatttgcttaccaagtggcattgctgcaaagaaacgttcgatcttagccaatgaaattagcggtgcaacgcgttcttcaatcaacccttgcgtggtcaaatcagcgaccaattcacgcaagtcatcgcgcgttggcgcaccatgttgcaaatcaactcgttgcaacaccaagtgggttgccgtaccgatggcagctgatgaaatccgcgtttcggcttcctgcataaactcaggttccggtagagtttcatcagtcaaacgcaatccgctcatatcggcaacatctagacgggcatcaaccggaccacgacccgcttgcaaatcggggtcttcaaacaaccgcttgatttcagaaactgattgataagctgtcgcacgcgtcgcttcttcaaagccgtaatcaaaattaaggacttgatgccaatcggcattcgcgacaacgggcgcattcgcctccgttgccacgacagcttgtggtgtggcaaccgcttgatacgcgtccagcgctgaacgcaaatctgcgctatccacaatttcaagaccaaaactaaatggcttcttgggggccttggcacggatttcgctgaaatcaacgacatcatcctcgtcatagcgacccaacgcctcttgtagtgctggcgcttgtgggtgacgcatcaacgccatccccatcaagtccataaacgactttccagacaggcgcacccagtccggcaacatccaatcggaaccattttcagctaacgaccactttgaccatagtgccttcacgctactgtatgaacccaccataaagaggtgttgctcggcacgcgttaaggctacgtatagcacacgcaattgttccgcaaaggcgccacgaatgcgggcatccttcacaaattcgcgttgtggcgttggcaacttcaaatggtgttccaaatcgacataatccatgccggctcccgcttgcgcatccaacaagacatcacccatcgtttcgcgctgactaatcatcttacgcgtactgttcaacacaaagacaattgggaactccaacccctttgaacggtgaatcgtcatcaatgacacactatcactcgccacgttggcatcagcttcacccaagtccttgtcttgagtttgcaactgcgtcacgtagttaatgaactgatacaagccaacaaaactactcttttgatacatcgccgcacgttcatatagggcgtgcaagtttgcttgacgttgtggacctgatggcaagccaccaacataatccaaccatcccgtcgtgttgtaaatctgccatagcaaatccacaatttgattctgaatcgccagcgtacggaatgtttccaagtcggccaagaagcgttgcacggcagcaattgtttcatttaccaattcaacagaaaccccttcaaccgaaattgtgagcgggttgttcgccaacgccttcacggccgtaaagaaatcatcatccattgcttgggtacgaatcaacgccaaaccgttttcatcaataccgtacaaaggcgaacggagcaccgctgccaacggaatatcttgatgcggattatcaattacttgcaacaaactcatcatgactgaaatttcagtggtttggaaatagttttccgccccattcaccacaatcggaatatccatctcacggaaaatgtccaacacatccaagttctgattcttagttggcaccaaaaccgtcatatcactatagcggaccggacgcttctcacccgctttacgatcaaagatttcgaacttcgtatccatcaattctttaatcttcaatgccatcatgcgaatttggccagtcgccttcgtgaaaccatactcgttcttcacatccggttcgtcttcttcagcgtcctcggcatcatcttgatccaagtacaccatcatttgggcttcctttggcaagtcagccggatagtaatcagcccccgcgaccaattcggcctcaccggcatattccacatcgcccaactgttcgctcataatctgcgcaaaaatgtagttgatgtagtcagtcacattcggttgtgaacggaaattctcctgcaacgtaatcacggtgttgccatcagtctttggatacgtcgttaatttgtgaccaaacaacgttggatcagcttgacggaacttatagattgattgcttaatgtcacccacttggaacgtgttatcaccagtcgcaatttgtgacaaaatcgcttcttgcagttggttcgtatcttgatactcatcgaccatgacttcgttataacgcgcttgtagttccgcagctaccgcgggttggctaacgatttgcaacgcaaaatgttccaagtcgttaaaatccagcaccttgcgacgaagcttctcggtcaagaacgcctcccggaaagcttgcgtgaaatcaaccaattgcttaatgacttcaccagccccaccaatggcaagttgcataccggcagcatccaaagcaaagtagttttcttgtagcttctcgaaacgttctttgatttgctcacgttgggccttaactggctcccaagcagcttttaattctgggtcatgctttgacgtaaagttctttcctttgccgtcttcacctttaccccaacccatcaaagtcactgctgcaaatgcctgacgtaaatcatcccaactagttggcgtatcttgtaatagcgtcaacagacgaccatacgcattggcatcgttttgaatgttcagtaaacgatttacagccggtggttcatccatcgtatccggtgcttgattaaccaactgtgtgatttggtcattaatggccaacatctcactttgcaacgttggcaataattgcgtcttaaagaaattagatgatgcaaaatcatccccaatctcatagtcatccgccaagctttccaaccatgccgttgtatctggtcgtgccatcgcaaagttgaacaacgtgaaaactgattcttgcaacgtgcggtcatcagttgaacctgacgcaaattgagccgcaaacttcgcaaacgtttggtctgggtcctcaacataacgttgctcaagcaaatcaccatagacttccatcatcaacaaggtacgctcggcatcatcagacaatcggaattgtgggtccaaatcaattgtgtagtgatattgctcaatcaagcgcaacgcaaacgcgtgcaacgttgaaatgttggcaacattcaatagacgcagttgcttcaacaagtgctgacgttgttcaccctcagactcggccaatgcaccgcgaattgcgccctcaagtcgctccttcatttcagccgcagctgcttcagtaaacgttacgatcaaaaacgtattcacattttcgccggccagcaagcgtcgaatcacacgttcaaccaggacacgcgttttacctgaaccggcggaagcagacaccaagatattttggccagttgtggtaatggccgcttcttgtgacgttgtaaaattcattagtcttctgcctcctcttcttcatcttcgtcgcccgtaatcatattttgcatcgccttcaaagcatcgtctgccttgagctttttaatattacggtattcattacccatcatggcatcaaacatcatgactggcttataagccgtgtacatcatgccagtcttatttggcccatcgcggaatggccatagtgggaattgtccggccaaaatgttggttgcaatttggcggattttggcttcgttaaactgcaataacgtattcaagttgtcttccgtcacaacatcagccgtcttggcaaagctaccactcttcaaacgcttcaaggcaaacggtgtcttcacaccctcaacaccttcaaggcgctcaatgtaggcttcattgtcacgcaagacaccacggtaagcaccttggctggcggctgctttatcagcttcttcctgtaattcagccaacgaggcacctgaaatatcagtggccttaatccatggattttggagtgaccagaacaccgcaccacccatttcactggttggtagcacatccgcgttggtcagcatcgccgtccaatacgtcatcaattgcaattccaaaccagcataagcttgcgtatagtcaaaggtacgcttaccagacttgtaatcgacaatcgtcaagaagttaccggctggcgtttccaccaaatcataacgatccacttttccgcgaaccgtcacgcgaccaattggcaactcatattgcaccggcttcaacttgctctgtggcaaaccaaaaccagcttcgacaccaagggtatgcaccccaccgtcaattaattgaccgcgcttcatgttctgaactgtatcgtgcacttgttccgccaaacgttgtgtcaagaattgcatacgggctgaactcgtgaagatatcaaacgtcgcatccccactttgaagcaatccatgcagaatgttttgctccaacagacgtaattcagcatccgtgaattcactcaatgtcttgttctcacgaatcaattccgtgaacaaacgttccagaatcgtgtgcatcaacgttcccttttcagccggcgttagttggagcacctgacgctcttgcaaacgcaaaccgtattgcaagaagaattcaaatgggttcttcgcatagttctcaagacgtgaaattgaagctttcaggtcattaccgaatagctgactcatcaacggcgccatgatttggcttggtcggttttcatacgtcaaaccgcccattacacgggcagccttcgccggtgccagttgcttaatttgtgcctgcaagccttgccaagcaccgctcaattccgccgactgacggtcttgcttttggttttctgcttggcggttcacaaccaccaagtgtgcgagcgtacttgcaacggttccaacgtattcatgaacgtctgtcgcatgtggatcaggcaacgccttaaactcatgcaccggttgatggaattgacgcaccaaacgcgtcacgtacgttgacgcttgttggctaccttcgccgtcacttgtcgcatacaaccaaatcatgcgggttgctgccgtcatcatcgcgctgtacatcaacaaggattcttgcgccatttgttgctcagatgtttcacgcaagaagacatgctcaggcaacttatcttgcaataattcacggtcaccatcgtgcaacaacgcctttgtacgagtcgttgctggcaaattaacgctagttgcaccaaatacaatcaccgtgtgatacccctgacgttgcacgattccactttcagatacacgcacttggtccattgtcgctggaatacccgtgtacttggcactttcaaacgccgcctggagtagttcttgcaacgtttcaaccgtcatttcagtgtgatcaaacaccgctacaaagtcatccagcaccccaataaacgtgcgccaaacttgttcgggttgttgggcagcccacaggtcacccgcttcaattgcagcatcacgccaggcaatcaaacgttgttgaatgccgatttgcgtcaaaaagccatatagttcacgcgccatctcacgggcatctttggcttccgctaggcgtgacaaaaacggtgccaccacttgactgatttggttgtgaatcaatgccaattgggcatccttagccgccacgtgttcgcgaaccacttcatcatctgaatcggctacattgcggtcaaactgccatggcgtgtcatccgtccaacgccaccctggcaaattcttagccaacgcatagttttccgtttccgccaacgcctcgcgataatcagccaatgtgacatcttcaggcaataatagctccgtcttcaacaaccccatcacatctgaaatcgtgtaggctggtgccaaacggaacaacttgtccaaaaaggccacaagcgggtgggcacccattggtcgatccaagtccataaagaccgggatttcataacgggcaaacaccgctggcaagatattctcatattgtcccaagtcccgcgtcatcagcatgaaatcacgatagcgtcgcttgccactggccacttcttggcgaatcatacgggccatttgctcaacttcttgatagcgcgttgtcgcttgccacacatcaaaatcaggtagcggtgctgattgcgtttgttgctgaataccgtgttgttcataatcaatccagaacgattcaatcgccgcaattgtgtcacttattggacgttgtgctgttacagcattcgccgtcactgggacatcatgcgccatcgcgaaatcacgcaattggcgtgccaaacgcttaggtcggtagaacaagtcattttctgacaacgtcacatctgagacactcgcagccccgtcgtcagcgggcagtgcaatcaccacgccacctgcacgttcaatcaaagcctcaacaaccccgcgttccggtgtcgtcatttgtgaatacccattaataaagtagtaatggtgtgacgtatccgtcttttccgccgccaaataaacgcgcaaagccgtcagcaattcactattcagatattgcccacggttggccaactcttgatccagcgcttcaccaatcaaagccaggtcctgcaacttcatttgcaacgtgccttggcccgataagttttcagccatttcacgcacttctggccacgttaaaccagcttgctttagctcaagaatctgactcgcgaattgactaataaacccttgcttggtcaacaaactaccatacaacactaattcatcttggtgttcacgtagcaaggcctgtactagcatcgtcataccagtcgctgacaaattagcttggcgataaatcggggcatcttgcatgtagtaccaagctaaacggctcaatgaaaagacttgcacatttggcactgcgactgcggccccgtgacgattttccagctcagccaaacgacttagcacttgaatttctgtttcaaacttaatgtggttcggtaccacataaaaaatctcggcttgctcatcggctgccaagaccttctgcacacgctccaatagcgctaattcatggtcagcactcgcgcgaccaaacaacaattctaaagccatgtgcgccccctttttcataacgagttgtatcttctcattttaccagctatacgtgaaaaaagaccccaggcttttgcccagagtctgtcagatttttagttattgcgccaactttaacaacgcttcagcaaaaattgccattgagcgcgttaagttagcaactggtgttgattcatttgcttggtgacttgtgaccggcacatccgggaactgaccaccaaaggcgacgccacgcttcaacaaacgggcatacgacccaccatttgatgtgcgtggattcataaacatccccgtttgcttggcataaaccattgatagaataccaaccagttcatccgtttccggcaccaagtgcggctccataccccctggccacacttcgaccgtcgctttaaagccgccaaggtatcgttgaacttgcgtcatcaccgcttgcacattaaccccttgcggataacggaagttcagcagaatcgttccctgtccattcaaactaaaacgcatcaccccgacgttcaacgttaggtcacccatcgtttcgtcgtgatagcgcaagcccagattgtcagcaccgatatcgtcatgcactgtctcaccaacaaattgcaaaaaggtcttagcatcatccgcaaacgcataccggtttaggaaatgtgccaaatatgtgccagcattctcaccatcttgtgggtaagcgccgtgggcctgaaccccattcaacaagagacgtaattcttgccccttgatttcggttttaccactcaaaaatggatattgggccaagtactgttcaaaatcatgcaccatctcgtccgggtcgggcacgaccacacgcgcacgcgcatcgcccggtacaacatttggacgcgttcccgcaatgaagcgacgcaaaatatagtcgccagtcgaggcactcggaaagcgtaattgtacggtttgaaaggccttttcaccattcacaaccggaaacgccccgtccggtgaaaagcccatcgttggttcgccttcttgttcgaaataacgtggcaaatcacgccaaccgttctcttcatcagtcccaataatcaagcgaatcttgcgagttaatttaatttcgtgatcagccaaatacttcatggcataatacgcactcatcaagtcagctttcatgtcagccgccccgcgaccaaagtataagccatccaaaatttccggcttgaatggatcgcgtaaccacccgtcgccggccggtacaatatcgatgtgtgtcagaattgccacggtctcatcagcgtcagccggaccatattcgatccaggtcaccatgttatcgacacgaccataacggaaaccgtcacgggcagccaattcttccatcttcgctaatgcacgcaccatgtcggttccaaatggtgttagctcagtttgtgtgtttgaatctagaatcgatggtattttaacaatttgattcaaatcttgaatcaaatcggcctcataaggctttgttcggtcagcccattccatgacggccctcttttctcatttgtttttaatactttgattttaacgatatctgttaacactgtaaagtaaaaaagctaccaggcagatacctgatagctttgcaaaattcattaagaacgcttcttgttgtagtagtagaatactggcaatccaatcaaaaccaatacgattgaaatggcagcacctgtaaagtcgttaataaccgttgaaccaatcacaaacaaagcaccgaaaattgcaaccaatggcgtaattgggaacaatggcgtcttgaacaacgtgtccatttcttctaacttaccttgcttgacttggcgacgcaacatgaagacgccgaagaatgcagccgtgtagaaaatccagatagtgaagatggcgatgtctgacaaacgatcaacacctgacgtgtagaagattgccaaaaccaacgtcataatcgttaccgtcgcaatggcgttcgttggctcttgcgtcttgcgcgtcaactttgacaagtacttagggaacaagccgtccaatgacattgcatacgccatacgtgggaatgacaacatcttaccgttcaacgttcccaacattgaaatgataattgccaaactcaacgcgcgtccaccaaagtcaccaaacgcagccttagcaaccgcgaacgtcgcgttgttttgcaaagcgacaaccttttcagctggcaaagcgtggtaaacaccaaacgtcacaccaacataggcaatcacgatcaaaatcaaaccaccaacgattgagcgtggcacatcacgacgggggttcttcaactcaccggcgatgtttgacaacaaaatccaaccatcataagcaaacaacgttgccaagatggccattccgaagccaccacctgattgtgagacttggtgaaccgtttgtcccaaggcatcaaccttaccaaagaacaaaccgtaaatgatcaacacagcgattggaatcaacttaatcgatgttgtaatcacctggaatctagcagccacacggttttccaacatgttcaatcctgcgatgaacaacaggaagacaactgaaatccaagttgcagctgacgttggcaagcccaagaagttagccgtcaaaaaggcagcgtaaccagcaattgaggcaatgacggctggtgcgtaaatgacaacttgcatccatcctgtcaagaatccagcagctggaccgtacaactcttcaatgtagctgtacaacccacctgtctttggcaagcgggccccaatttcagcaatcgtcaaaccagcagccaacgtgatgacaccaccggcaacccatgccaatagtccaagcgttgatgaaccagctgtttgcaaaaccccagcttgcttaaagaagattccagaaccgataaccgttccgataacgagtgataaccctgaccaaattcccattgatcgttttaattcaactttgttttccatgacctactcctagattattccgttcttgcataaaaaaacagccacccaatcccagtgattggatgactgctaatcgttctcacagttcaagcgttacacgaaaacgcccaatcactttttgtgttgagttgaaacgatcattattattattgttgttaacaaaactgaacataatcatttctccttccaaaaagtgtgcggttttcataacgattaaaatcttatcatattctaagaattctgacaataaaaaatggtgaacccatttggattcaccatttctattagttacttattaagcttcttcgtaccatgagtagtggtacatttcaccagctggcttgtccgtacgctcgtaagtgtgagcaccgaagtagtcacgttgtgcttggatcaagtttgcaggcaaaacttctgaacggtatgaatcgaagtatgcaaccgcagctaataatgatggcactggtacaccagcagccgttgccaaagcgattacgcgacgagcagctgcttggtacttctcagcgatatccttgaagtatggatccaacaacaagttgtgcaaacctgcttcgttgttgtaagcatccgtaatacgttgcaagaagcgggcacgaataatcgcaccagcacgccacaattgtgccaactcaccatattgcaagtcccaatcgtagtgatctgaagccatgcgcaattggtcgaaaccttgtgcgtatgacatgatcttaccgaagtacaaagcctcacggatgtcttcaacagttgcgtcgacatcaccttcgaagttgaattctggaccagccaaaaccttagaagcagccacacggtcttccttcattgctgaaatgtaacgtgcgtaaactgattccgtaatcaatgattgtggggcaccaacttcaagagctgattgtgatgaccactttccagttcccttgtttccggcacgatccaaaatcatatctaccattggcttacctgaacccaaatcgtcatcacgcgtcaaaatatcagctgtgatttcgatcaagtatgagtccaactcacccttgttccactcagcaaacgttcctgccaaagcatccttgtccaacttcaacaagcgcttcaacaagtcgtatgactcagcaatcaattgcatatcaccgtactcgataccattgtgcaccatctttacgtagtgaccagcaccattaggtccgatgtaggcaaccgttggcttaccatcttcaggtgccttagcggcaatttccttcaagattggttcaaccaaatcataagcttcgcgttgtccaccaggcatcattgaagggccttgcaaggctcccaactcaccacctgatacacccattccgatgaagttgatgcctgattcagcaagcttctctgaacggcgcatcgtgtcctcaaagaacgtgtttccaccgtcaatcaaaatgtcacccttctccaagaatggtagcaattcttcaataacagcgtcagttcctgcaccggccttgaccatcaacaaaatacgacgtggggccttaattgacttcacgaattcctcgacagtgtaaccaggtacaaacttcttatctgagtgcgtttgtaccaaatcttcagtacgagcgcttgaacggttgtataccgcaaccgtgtagccacgtgattccacgttcaaggccaagttacgacccattacggccaaaccaacaacaccaaaatctgcagttgccatgttttattatcctccaaagtgtgtccttaatccctcgattgactataagtctagtcttctttattttaatgtcaaaacaaaaaaattgtctgtgaattaaatgtgaagttgtttatgacatatacaaaaattagataatcctatgacaataggctgtattgctaatttttgcaaagaaaaacccacgcagatgcatgggttagtttcattattcatattgcgccaaaacggcagcgacaacgtcatcactagctgaagtcgtcatgaaacgacccattggcgtaatctcgtgacgatctttaaaggctagcttctttgtttcaactagcatgaccgtcaaattattttccgtcaaaaagagttgaccaggcttacctagcttacccttcgtgtgcttaccaatacgccagctgtgaaaatcggctgctgttagcggattttcctttggctcataagcgccactattactttgcgtcatcacaacgccaattaattctgctgttggatatttatctgccatatttaacctcggtagtatgcccacggtacttgtggatcgaattgctcatcagttgagacaacaagccccttcttaaagcgcgtcaacaaccagaaacggagtggctcagggataccaagcatctcaaaatcactcgttgagatagcatagcgaatccctttttcatcattattcatgactttttgcacccagtttggatcgacaatcagctcacgcgcaatcgcagccccatcaacgccagcttgcacaagtgcttcaacttgttctggcgtacgcaataaaccagcgacaatcaacggaatgtcacccaaaattgccttgtacttggcataaagtggttccttatcttccttattcataaatggcgtttggaatgcatcctttaacgagatgtggaagtatgaaattggacgcttgataatttcttgggccattgctaatgaatccgtaaagcgaatacccggcgttgttggctcttcaggtgattgacggtaaccaataatgaattgttcatccgcaaattcatcacgtgctgcgacgacggcatccaaaaccgctaaaccgtaacgcatgcggtcgttcaaatcaccaccccattcatcagtgcgttggttggcgtgctctgagaagaattgttgcatcgcatacatgttggcaccgtgtaactcaacaccggcaaagccagctgcaatcgcacgacgggttgcttcaccaaagtcggcgatgctttgacgaatttcctcatctgtcatcggacgcggcgtggtcatccccggttggtgacctggtacatcagaagggccaacgacgtcatcatgcaataccgctgccgtttgtgcaatacggccaccaaacgacaattgcaaaaccggcactgacccacgattcttaatgacgtccgcaatcttcttcaaccctgatatcttctcatcagagtcaatgccaatttgaccaacgtatgtcttaccggccattgaaacgtatgccatttcaacgatgaccaaaccaggtccaccagcacgcatcttgtagtagttcacctcatcatcagtcacaacaccagtcgcaaaagatgatcgcaaagtcgttggtggaaatacgacgcgattctttatttcaacaccattcgccaacttgaatggttcaaggaatttataactcattgtcattaactctttcttattattagtgacactattatagcattatgtacaactattaaatttttgcacctctttttcttgcggaaacatcaccatgtacttacaataagtctattcatttcattgttaacattttcaagcaaagaaggggacacaaacatgaagtttgaaacaaaggttattcacggtggtacacaaggggatccagttactggtgctgttaccacacccatttaccaaacatcaacctatcaccaaaaggagctaagtggtggcgctaagtatgagtacacgcgcggtgagaaccctacccgcttcgctttggagtcagttatggctgacattgaaaacggaacggatggatttgccttttcatcaggaatggctgctatccacgccacaatgagtttgttgaaggccggcgaccacatcgtcatggccaacgacgtttacggcggaactttccgcttggttaaccgcatcatggccgagttgggcattaagtttacggcggttgatacggctgatagcgatgctttgaaggccgcaatgacgccagaaacgaagatggtttacttggaatcaccttctaacccattgatgcacgtgacggatattgctgaagcatcaaagattgcacacgaaggtggcgcaatcgccgtagttgataacacattcgcttcaccatacaaccaaaacccattggacttgggtgctgacgtggttgttcactcaggaacgaagtacttgggtggtcacgccgacctattgtcaggattcgtggtcgtgaaggacgctgagttggctgagcgcattaagttcatccaaatgtctattggtgcagtcttgtcaccacaagattcatacatggtgcaacgttcaattaagacgttggctttgcgtgtgcaacgccacaacgaaaacgcgatggccttggctgagttcttgaacaaccacccaaaggttgccaaggtttacttccctggtttgccaggtacgcctgatcacgagattgctaagaagcaaatgcgtggtttcggtggcatgatgtcaatcgagctacaacctggtttggatgttaagaagtttgttgagaacttggatgtcttcttgttggctgagtcacttggtggtgttgaatcattgattgaagtaccagcagtgatgacccacgcttctatcccacgcgagattcgcattgctaacggcatcaaggatgagttggttcgtatctcagtaggtattgaagatatcgacgacttgattgccgacatgtcaaagggcttggatgccttgtaatattgataaagtaaactccccaacgattccggtcgtttggggagtttttcgttatgtagttttgtggtgtgtgtccgcgccattcggttgccccaatttgaactggccgcgaccgtaacggagctcgctccgtgaaggaagtgtagccggcatcctttgaaggatgtaagccggctactagatagttccgcgcacccatgcctcgacgcaacgcgtcgacacacaccaccaacttaaaaccaaccaaaagtgcaaaataaaaaccgcgtgaacgtatatctacgtttcacgcggtttttcagtaagctactgataaagtcaaattactttgactccaattcagccttacccttggcccattgttggatgttaacaacttcagccacacgagccttctttgcagaatcgtgtgatgttggtcgcttacgagcccatgagttgtatggtgattgaacagccatgatcatttcctccatttatgttatcgataactttactagtataccgataaaaacaaagtgcgtcaaacttttatcccaaatccgtcaatttttcatcgcgtataagttgtgaacactcagcctgcgccgtatactaaggttactatgattacacaaaaaacaactttcccagatttcgtctggttccaagtacatgatatgactcctgaggaacgagaatggttgaccaaagaccaactcattcccaatgaactcctaagttatgccgtcgacccatacgaaagtgcccgtatggaatatgacgaagcagctgatttgacgttgatgatttttgacgtcgtcacaccaacatcacctcgtgccacaactgaacccgttggcatgctctttagtaatgaccaacaacgcctctacaccttcactcgtgaggaaacggattacgtagacagctacctaagtggtaccgaagtcagccgccgtcccttgcccgaccacgccacgccacttgatgtcattttgaatggtacggagctactttcttcaaagtttatgtcggcaattcttgaaatcaatcgccgtcgtacgcctattcaaagtgaaattcgcaagacgaagcaaacgcaaaagacgatcgatcaattgatggatttgcagacggatttgatttacctattgaattctttgcacaccgaccgcgacttgctacgcagctacaaggcgcgccacaacattcaattgactgatcaccaatcagaacgtattgatgacgtcacagtcgagttgcaacaagccatcgacaccggtgagttgtcacaactagttaccaaccgcgtttcagacgcctttgttaacctagccaattcaaacctgaactggacaatgaagctgttgacggtctcatcaatcgtcctaacagtgcccaacattgtgtcagggttcttcggtcaaaacgttgaccttcccttcatgcatacccacatgggctggattgtgacgctcatcatcacctttattatgatgaccatcacaacaatcgtcctttggcgttcaggatttttccgcaaataaccacttacagcagagcctttttcaggttctgctttttctattttttcttgtggataacctgttgaaaagcagctaaccttcccacaagaaaatgagacttatccacaaaactccagacttttgcacacctacttgtggataaagcggtgcaaaaaagccgactgcaactaaatgcaatcggctaatttcgtttacttcaaatgtaatttgtgcgcgatagttgctgcgcgttggccaagaacactttcaccaacgtgagtcttcagcattgaaacaccgtagataccagcaccaactagaccaaccacaaccgtaacaaccaattgtgccatctttgtatcaggcacgaatagcgtcaacgtgttcgtcaaaagtgctaccacagcgtacataaccaagccccagaataggataaccatcaatgagaaattgaatggcgcccattcgatggcatatagcacgctaagtcggcggattgaaataatcaagccaaccgcaaaggctaggaccgtcgccatcaaaggaccggcaccttgcaaccaaatcgtcaaaggcacttgcaaaatcaacttcaagatcaaaatcaatcccaacaccttcaccgtgaatgacaactcattcaacccttggtagatggccaagacaaccatgtacaagcccaaggcaatggccgtgaagctggcgaattgcaagattaacgttccatttgttgcatcattcgtgttatagaacagaatgtatagtggatgtgcaacggcggccatccccaatgaggcaggcaccatcacaaacgctagcaacttaaaggcgaattgaatttgatcaccaatgttctcgcggtcaccaatctctttagctcttgccaacattggcaatgccgtttccgccataccaacggcaagtgacacaaccaacatgaccaacttgtttgagttaaaggcaaattgggcaaacatcgcttgcatcgcattgtgcgttgctgacgtgaacgccctcataatgtggaagaacgtatattggtcaatcacttgcacaatcgcaatcgcagaaccagcaaagatgactggcaatgattggcgcgccatgcgaatcatgatttcgcgtgggttgaaatctggcgctggaatattcatcgccatcttttcagcaaagaacttacgacgcttccagataccaaataccaaaacgatgattccggctagcgcaccccagaaggcagccaacgttgattcaaccgtggcatcgacccatgttccgtgatgaccaaccataatccagtacgtcattcccaacatgtaagccacacgaatcaattgttcaataaactgcgacagcgccgacaatcccatgaactcgaatccttgcacatacccgcgcaacatcgatagcgttggaatcaacaccaatgcggccgatagcgaacggataacaggcaccacattcgcatccccttgtgataagactccggccagcaagtacaagatagcaccggctgcaattcctaacacaccaccaaactgcaacgcttgacggaagatacgacgcacggcttcatagtgacgtgaaacgccatattctgcaaccaaacgtgccaagacattgggcaaccctgccgtcgcaatcaacaaggccacactataaatttggtaaccttgtgcatataatgagttggcagaattgaaatacacatttccaatcatcgccacccatggaataacatacaaggcacctagcacacgcgatgccaggctaccaatcgtcatccaggcagaaccacgcaacatacgtgattctgcgttactatcatcaactaaatcagtttcaatttctggaacggtcgttaattcatcggccaccataattggcgcctcggccaatgtctccgcttcttccgcgaaagcctcaggcagaacacttggctcagataccgtaatcgtttcgctagctggactaacagccggcgcaacgtcaatttcactagccggctcatctagttgcgttggcaattcagaacttgctggcaattgcacgtcagccgctgcttcatcaattgcttcactcgcgaccgacttaggcgtatcctcacgaacaaatgtatctgcaacttggtgtaccttaatcgttgatactccttcaggtcgcgttaccacttctgccactgagtgcgactgcgtaggtgtcgttgtcgcttctgatgttaccttctcttcatcacgtgcttcaaagatgtcatcaatcgtggccccattgaggagagcagccaattcttcaaacgtgatgtcgcgtcggaatggtgactcttcatactggggtgatttttcatcagccatgttgaccgttcccctttctttcattaaaaaaatgacgctacacagactcgaactgtgatctaagacttaggaggtccttgttctatcctgttgaactatagcgccaaagtattccaagtaactattatacacaagaaaacccgttgtttgtagttgatatgtaatatcaacccatccaacgggtatttcatttaggcgacaatgtcttgccactttgccagaattgccgacaattcaaaatctttggcacgttccaatgacttcgtagccaataagcaacgcatttcatagctttgcaacatcggttctaaacgataccacaatgcgtcagcgtttttagctgccaactcaccatagatgccgccgtccaaaatttcgaccgctcccgtattgtccgtcgacagaatcggcaagccaaagctcatcgcctcgaccaataccaagggcaagccttcccaacgcgatgtggcgaggaaaatcgaggcttgacgataatgttcagccaattcttcatcatgtaagccaccacgataaataattttatccgcgacttcattcgctttaattaaacgctcaaaagacgccatgtcatctggtagtccttcaccagcaatcgcaatctgccaatcatccggtagcttcttagccaagttcaacataatatcaatgcccttatgctgaatggcaatgcgacccgtgaacgcaatcgtatgcttagttaaatcagcccgaccactcactggcatcgtcaacggattccaaattttaatagcccggtcagtcactgtttggaagccttctaaatcagtttccgttaatgcaaccaccgtatcggctgctttgacacccgccacaaattcagctcgcatgtcacggtaatactgattaaagtaggtatcgatattgttatgcatccaggcaatcgtttttagttcagggagtcgtgacttcaggtatggaataaaactcgttaagataccggcatttaaaatcacgacatcaattttctcttcaatcaaaatatcagccaaatcggtcatttgttgctgataggtgtgcaatggatcagggccatttgctggcatgaccggatgaggcgccggaattaaacgccccttcaactcgtagtacgatggcacatcagccatctggtaaaaagcaaccgtggcgaattcagtcatggcattgccaacaaccgttgctgctcgcttcatgccacccattcccaggttctcaacagccatcaaaattctctttgccatgccctgcacccccttgctttgcatactaaaagaggaacccccacaaatgcgagagttcctcttcagtatagtcactattgtttaaaaagtggcgctagatgtcttaaaacctgacatgcagattacaaaacaacgtttaccaacttacctggcacagcgataaccttctttggttgtccaccatccagttgcttttgaacggcttcgtcagcgattgccaactccgtcatcttctcacggtcagcgtccgcaggaatcgtcaaacgaccgcgaaccttaccgttaacttgcaaaacgatttcaatttcgtcttcaaccaaagcagcctcgtcaaacgttggccatggttggtacgtcactgattcgtccttgtgcaagaagctccacaattcttccgtcatgtgaggggcaattgggttcaacaacttgatgaatccttcaacgtattcaacaggcaagttttctgccttgtatgcttcgttgatgaaaatcatcatttgtgagatggccgtgttgaaacgtagaccttcgtagtcttccgtaaccttcttaaccgtctcgttgtagatcttgtccaacttgtggtcgttaaccgtcgtgatgtggtcgcgtagcttgtcttcatcatcgatgaacaaacgccatacacgatccaaccaacgacgtgaaccagccaaaccgtcttctgaccaagcgattgattgttccaaaggtcccatgaacatttcgtacaaacgcaatgtgtcggcaccatattcttcaaccacgtcatcagggttaacaacgttacccttagacttagacatcttctcgtggttttcacccaagatcataccttggttagccaacttttggaatggctccttggtgtggacaacacccaagtcgtacaaaaccttgtgccagaaacgtgcgtacaacaagtgcaacacagcgtgctcagcaccaccgatgtacaagtcaacgttcttccagtatgcctcagcctctggtgaaacaatttccttgtcgttgtgtggatccatgtaacgcaagtagtaccatgatgaaccagcccattgtggcatcgtgttcgtctcgcgcttacccttgcggccgttttcgtcaaccacgtttacccagtcgtcaacgttaaccaatggtgactcaccagtacctgaaggcatgatgttatcaacttctggcaaacgcaatggcaattggtcttctggtacaagcgtcttttcaccgtcttcccagtggataacaggaattggctcaccccagtaacgttgacgtgagaagatccagtcacgcaagcggtagttaacttgcttgtgaccaacaccttgctcttccaaccaagtgattgccttttcgatagcttcttgcttacccatgccatccaagaagcctgagttgatgtgctcaccgtcgccagtgtaagcttcttcagcgatgtcaccaccggccaaaacttggcgcattggcaaatcgtacttcttagcaaattcgtagtcacgcgtatcgtgagcaggcacggccatcacggcacccgttccgtatgatgaaaggacataatcaccaacccaaattggcaactcttcaccattaattgggttaattgcaacggcacctgtgaacacacctgacttatccttattcaagtccgtacgctccaaatctgactttgaagcgattgacttcttaaaggcttcgatagcatccttttgatcatcagaaacaatttctgataccaaagcgtgttctggtgacaaaaccaagtacgtcacaccgtacaacgtatcagcacgcgtcgtgaagacttcaacttcagcatctgaatccttcaccttgaagtttacagaagcaccgattgagcgaccgatccagttacgttgttgttccttaatggcgtctggccaatcaacatcgtccaaatcttccaacaagcgatcagcgtaagccgtgatcttcaatgcccattggcgcattgggacacggtaaactgggaagccaccacgctccgtcttaccgtcgatgatttcttcgttggcaacaaccgttccaccattgtaatcaggggcccagttaaccatgatttcatcttcgtatgccaagcccttcttgtacaattgttcgaagatccattgcgtccacttgtagtacttagggtcagtcgtgttaacctcacgtgaccagtcatatgacaaaccaagtgtcttcatttggcggcggaagttcttaacgttctttgccgtcacgacacgtggatcctcacccgtcttgattgcgtactcttcagtaggcaaaccgaacgcgtcgaatcccattgggtgcaaaacattgaacccttgcatacgcttcatacgtgaaacgatatcagttgccgtgtaaccttctgggtgcccaacgtgtagcccttgccctgatgggaatgggaacatgtccattgcgaagaacttttcctttgagtggtctgatgacgtcttaaaggtttgattctcttcccagaagcgttgccacttcttttctacttctttgtgttgatatgccatgattgataacctcactttaatgttctaactttaacaaaaaaatgccgttctttcaataaatgagcgggtttataccggtgtttcacacgactaatcattaatccaaattgtgatacacttagttaatgaaaaagtagtgaaagcgggtgtccatatgtttcaaatgcgtaagtttgattattttcagcttgcggttgcctttgcggggttaatcctatttattttattagcaattggctatacccaccatttgggttatatcgattggattgaccagtttggcttcaaacatatccggcaaccagtcacgccagagcgctcttggttcttccgtaacatcacccgcgccggtaacccaaagtggacgttgattgtgatgacagcgaccgccattgtggcattgctagttcgcaaaatcgacgtggccgtctttatcgttttgaacgtcggtgtcttcggacttggtgtcatggcactacttaagcacgttttccaccgaccacgacctgacatttatcatgtcatcagccaaggtggtttttccttcccatcgggtcacgcactcaatgccgtgctattatatggttcattgattgttctcgtacattattacttgaaacaacacgaccaggtgcgctatgccatcatgacattattcgccgcgctggtcgtcgccatccccctcagccgtgtctatcttggtgtccactacttatcggatatcctggccggtttcggacttggtacctttttcctaattatgtcgaaggaacttattttcaaatatcaaacacgagaggttttcgaacatgcgatcaactcagaatctagcgcaaatcacgctgaatgaatatttagtaccaggcgacttggccattgatgccacaattcgtcgtggcgacatcacgcgcttcctcgctagccgtgtgggtgacactggtaaggtcttggccttttcagatgttaaggctgaaatcgacgacgttgccacatcacttttcttgagtggtttgcacaaccgcgtcgacctaatcagcaaggacttctcagccgttaccaactatttggacccaacaaagccaatcgccgctgccttgttccaggttgacgaaaacatggatacggagacattgacggcgaccgttaagacattgttgatggtcttgaagacaaatggtttggtgttgttgctgagtgacaacccagccaacctagctgacgcccaagcttacgtggcacaattgccaacggattcttatggtgtccaaaaatacgaagacgtcctaaccggcgaaaccgccttgttaatccaacgtcgttaatcaaaaaactccctgagcccgcaagctcagggagttttattttacttattaattggctcaaacaccgccaccgcttcaacgtgagcagtttgtgggaattgatccagcggttgaatgtcgcccttgatgcggaagcccttgtcaatcaagtacttagcatcgcgcgccattgtctctgggttgcatgacacataaacaaagcggtcgggattcatgtccgcaacggcatccaacaaatcttccgtcaaaccacgacgaggcggatcaacaaagataacgtccggcttcaagccaccgtctttccacttttgcatttgttcaggtgcgtcagctgtgacgaattcagcgttcttcacgttgttgttagcgacgttcttttgcgcgtcaatcacggcacgctcaatcacttcaacacccaacaccttgtcgacacggtcggcaaccgtcaaaccaattgttccgatacctgaatacgcatcgataaccgtgtcagattccttcaactcaccctttgttgcggccatgtcgtacaacacttccgtcgtttgtgggttaacttggtagaacgaatttggtccgatttcaaaatcgatatccaacaacttatcgtgaattgcatcggcaccccacaacgtgcgattgtcacctgacgtcaacacgtgcaagctacgtggattgtggttcaagatgatactcttgatgccatcaaccgcctcagcaatatccgcagcaatcgcatcttcatccgtcaacgttggcgtttgcgttaccaataccaccataacctcgtgactgtaataaccacgacgtaccatgatgtagcgcatttcaccttcttgggtatcgtcatcaaaaaccgataccttgtgggcgtccaaaatatcacgcacaatcccgatgatttggtcgatcttttcgtcgttaacgaagtaatcatccaatggcacaatgtcacctggcgtacgcttcttaatgaagccagtcgtcaacttgccatcaacatacttcactggcacaaccgtcttattgcgatagtgggttggattatccatcccgatggttggcgcaacatcgacatcaataccgtattccttgtacaacttttgcacttgttgttgtttcaaacgcaattgcgcatcgtaggccaagttgacatacggtgcgataccagcctcaagcaaatagtccttaccagacgccacgcggtctggtgacgcttcaagaatttctacaaccttggcacgaccgaacttacgattgacctgcgtcacctcaaataaaattttctcgccttcgaaggcgttttccaaatgaattggataatcatcaaccatgatgactcccaatccagtgtaaagcacgtcgataacaacaccttcgcgttgctcacccagctttaccggaataattgtattactcatattttctctcgtttatcctttttagtcgctttccattataactgaactgaattacttcgtgcgaccccacaagaaatcaatcattgcatggttcacctgctgattgttttcgtgcagcttactgtgttgtgcttcagggccactgatcaagcgctcttgatatgactttggccggtcaccgagcaagtattgcagtgacttcgccgacgtcgttgaaacacgtccgtccgagtgcgtgccgtcatccaaatcaccgtaaatgttcaacacatcaacttggttctttggataattatcttggcgggccaacaaccaatcatagtacgacactgtcttttcaggcttgccgaggccgtccaaatgattatcggcaacttgcttatcaatgccaacaatcccatcgaagtgaccggcaatcgatacttgcttgcgtaactttggcaatgacttatcttgaccgtatgtcatttcataagtcatcaatcccaggtttcccatcgaatgtgcgacggcattgaatgacttaatgccatacttatgctgtaatgcaaccacgacattctttatccacttggcatccgtttgataatccgtattacgattatctgaaaataccacttgcaccattggattaaaacggttcttatcccaatgacctgacaacttcacgtgaccatcatcagtcacgcgcgccgtcagcattttcttagccgccccagacttttcagctgcacggactaaatcctttgttgaattcagcgtgccaccataaccgtgaatgaacaaggttggtgtgttcgaatagacatacttatctggattacgttttagcttcaacgaatagttcaaagcaaaaataaccgcaaaaatcgcgaccaatccaactataatactgacccatcttttcatcgtgcatccccctttgcattccgaatgagtgtttaattcattttttgtccgtgttcaatgacataagctactgaaaccggcatcatcttgccactatattctactgccaaagcgcgcgccgtttcgtcttgcgttggcacaaccgccacaaaagatccgtcatccaagcgatacatatccactaattgccccgcatcattcaacaagaatgaaaaatcaatcaaatggttgtagtcgtcaaacttgaacggacgctcatctacgcgttcttcgcggactggttcaaccggttgctcaggcatccctgctgccaattgcgccaccaactcaaaacgtaggttcttcatatccaacaattgcgcttggaatgaaattggcgcttcatcaaccaccgaccgcacaaacttaggcaacaggcgctttggacgcgtaattggcgctgataattctgagaagaatgcgtagatactcatcttgcgatcaatcaaatcatccagcgtcacttcaatgtgcacatcatcgttctcaatgcgccaaggcaattcctgcccgttcttcaaatcacggtctgaaaccaacggcgctaccatcgtccccagcgtaatcataatcaagccatcaacttggttaatcgtcacatcaaattgcttggtggcatcttcaaacaacatccctaccgtgcgtgttgagaacatgttcaccatgcgaatatctgctagtatcgcagttgcggcatccgcattcttgtctgtaattaaatcgaccaactcgtggtacgcctcaaggctctcaaaatcagttggcgttaggattagttcgccataatcgtcaaacatttcatttagtaacatgtaacaccattccaaactcttcttatttattaataatgataccagcgtttgcgatgcaatggtaatcatgagacactactggtagattcatcagaaagaggggatattatcgatgacaaaatatgataaagaagcattacgtcaacggctcacacctgaagaatacgccgtcacacaagaggcagctaccgaagcaccgttcactggtaagtacgacgcatggttcgatgacggcatctatgttgacgtcgtgagtggcgaacctttgttcagctcaactgacaaatacgacgccggctgtggttggccatcattcactaagccaattgagaaaaaggccgttaagcgccaccttgatacctcacacggcatgttccgaactgaggtcacctcaacggatgctaactctcacttaggtcacgtgtttactgacgggccgattcaagaaggcggattgcgttactgcattaactcagcagcaatgcgatttgtgccggttgatgagctagataagcagggttacggcgattacaaatcattattcgaatagcacaaaaggacggcatctctgccgtcctttttgtgttctaaaacgtttaacaacaaccagttatccgaattcccaggcctatatcttcctaattttaaaaacaatcagcttgctaattatgtaattcaaaataatgaccacgatattatcaataatcttccagacgatagggtcctgatttagtaattgaaccccaaaccaaattatcaccatctccacaaccagcgtcgctaatctagcaagcataaaagaaatgaactcgcgcagtaattctaacttggtaaccgctccagaattgaatacccagactctattagtgaagtaagcaacaattacagccagtaaccatgaaacaacaaccgctatttgcacgtttattccaatgaataacaatagtgcgtacgaaacaacattgataattgtggttgttactccaaaaatcccgtataaaataagtgccttatatttttcaaacctggcaaacatgcgcagacgcccctttgcaataaataaaatagagggcaaaatttcttacgccctgtaaccacttaggtcaatgtattatcatcccccacatgttgtgcttaatacgtaattttgtatatgtcacagttcacttaccgattttacacacgacattgtcttgctggagataaaaatttgcaactcactatgttcattacataacaaattatatctctatcaataaagctcccccttaaaaaagaatacatttcaattcaaatatttgatattaacaatcatcaaaccatcgatcgactatactcaaaaggcagccgacctcaacaatgtgaaatcaactgcctaagcgaggttcaaagtcatccgtaccgtgtgcctttgagcctatttttttacttcactggcaccttcacgtcaccagaaagaatttgcttcttagctgcttcgactgcagaccatgccttatctgacatgttaccgcgcgtcaccgcaacacccttatcatccaaaccgtaaaccaagtgcttaccacctgggaacttgttttcatctgccatcttcgtcacgtcagtcacaactgtgccaacgcccttcgttgctgacgtcaacgtgaagtttgatgcgccgtcagttgccttgtattcaccatcggctgattgatcaatatcaaccccgataacccaaaccttatcggcctttgtttgcttttcgttcaagtccttcgcctcagtaaagacacccgtaccagcgccaccggcagcttggtaaatgatgtccgtaccgttttggtacattgaagccgcaatcgtcttggccttaccggcatcagcaaaatcaccaacatattgcacatcaacttgaatatcaggattaactgacttagcacccgcaataaagccagcttcaaacgtatcaaccaccgctgacttcatgccaccaacaaaaccaagcttgttcgtcttcgtcgtttcagctgccgcaacaccggctaggtatgatgactgttctgagtggaacgttactgagacaacattcttacgtgtctttgcaacgtcatcaataatcataaagttgttctttgggtacttcttagcggccgcattaattgatggcgtctttgggaagccaataccgtagatgttctcgtaaccatttgaaacggcttggttgatgtttgtctcaaagtcagctgacgtcttggcttggaagtatgtgtaaccacccttaccttccttcacattattcgccttcgcccacttcgtcaaaccttgccaagctgattgttggaatgacttgtcatcgataccagctgcatccgtgatcaacgcaacagatgtgtgttcgttcttagcttcaactgaaccagagtgcatgtatgccccgatacctgcaccaaccaacacaacagcaccaattcccaaaacaactttacgattcattatgaaatccccttaatagatataaaacacgaacatttatttcgtttttaacaacttagatatcataacccgaacttacgacgttgtaaagggtatatttcgtaatttaatcgttttaaccagctaatcccttactaacaaacggttaaaacacgaacttcagcattatcgtttacataaagttcgtgtttagcgcaaaaagccgagacatcgcattgcatgtctcgactttccatcatttattaattcgccaaaatgttaacaatatacaatcccagcttctgatgcatcacgtgtgcccggtgtgtctcttgcacaaccgacttcaactctgacacatcatcagtaatttcgccttggacacccttagcataggtttcaaccctgccttgtgagtcattcaccgtccaggcataaatccccttaccacgctcattcaaattatcgacctgactttgcgtcaaataagagtattccatcgtgtagaaatccgccttcgtcactggtgcaccaataaagtcacccggcaaaatcatgccgacttgcagcttcttatccagcgtcttcaaacgctgcacgactgaatagttcaaactgtgcatctgccagccgtttttatccatcgttgtttggaattgattcaagaatgaatcatctaagtcaggcgcattagttcgctctgtcttaatttcgactagtagttttacattgcaacgttctgctgctttggcatattcttcaaagctcggaatcttagcttggtgaccattctcatagacggtcaacttagttgcttcggctaacgtcaaatcagaaactgacttgtccgaagcgccctttgtcaaagctgccaaatttggatcgtgcatcaccacccatttaccatccttagtttggcggatgtccatttccacaaaactcggacgagcatgcgacaccgtatcaatcatcgccggaatggtgttttgcaccccgttaccgtcatccacaccacggtgcgacaaggtcaccaatggtcggctaactgtattcacaacgaagaacaatgacggtcccgctccttggatcaacgcacctagcattaggattaacccaacaacacgctttgtgtggcgtggcttcgtagcataatcaacaagctgcacaacctgataatcacgagccatcagcccaataatgaactgcaaactcatgataccaaagaaaatatcaatcaacgtcgcaaacgtgaaggtcacaactgctgttaacgcactgaccatgaacggcgcaaaccaatcgacaatgtattgcgcactccaagtcaatccaaagacaatcaacgttagcaagccaaccaaaatcgaaccagccaacagtgtcagcgctaatttaataccttgcgcgccacttgttttgcgccaactgtttttgattgccaatcccgctttatgttcagccagcataatttccggtaatacgtagaaaaagcgaattgcgaaaaacaacgctgccaaaccaagtacccagataagcgttagcatccaaggtgtgccggtaatagtcggccacacgaattgtggaatgattaaatccgccgttaattgcgagtggaatgccagcatcgggaacggcaatacgacaatgccgtaaaacaaaatcaatacccacgcaccaacatcaccttggcgcaagcgatgcaacgcggtcttgatgacactcgtcgcagtcggacgttgcccctcgtgtactgccgaaaagccaatcgtgtaactggccaattgactgataaacaccgttaatagaatcagcaccgtgatgactaaaataaccgtgaagattggattttgcatcagcacttgccccacatttgaaagggacataaacggcacttcatccagccattgaccgacgtacaacaaacctttcaaagctgggacgacgataactgaaattaaaatcgtaatcgagaagaacagccgactaagcgtccatttcgattgccaaaaacgacgccataacagcgtccagattgtttgtttcatactatttttctcccctaaacccacatgttttgccaaattataccaaacagatttgcatatttaggtttagggcactcactattggtttttcttgtccttacgacgcataatccaagctaagaacatcgcacagaacgcaaaaataccaacaagatatggtcgtacgtccgccactttttcagtttgttcgtccgtttcctggggattagctcggccatctgttacttctttacttgagccgttgtaaacaatgcgatcatcaattgcctgaccttggtgtgagcctctgttagttgcggcgtatgggttcgatgcacctgacgcatccccattagacgaaatcatctggtcacccaccgcattgggtagtgaactagttgctgtctcacccgctggggtgatgacattattctgtagaccattatcgttccaaataggcgtgtccgtcgattccgtcgccgtgccaactgtcgctgcttgagcgttactcaaaggcaacggtgctgccactacgttattcgttgactcatcattcgtcgctacgttcattgcagtatcaaccgccactgtttcgtccttttgataatttgtggttgttgcagtattactcgttggaactgaatcactttcagctgtttgttccggttcgggttgctcattggcagccgttgcttcctccacgacttcttctacttcggccacggtatctgagtcactggcttcactgctaaacgaacttaccaaactagctgacaagttagtcaggtcactgatttcgtcatgtgcccactcttttgcattcgccaagttaatcgcttcggcttcgtcgataatcgttgtgacctcatctgaagttgtcgcatttgcaacacggtccttgtatgatgctttttcgtcatcagacaaatacgccatttcatcgatttgggtctcagtttctgcttgttgtagtgctaactcgtcagccaatttggcatcggcaacgatttgctcaaccgctgccactgtatccgcattcgaaatctgatcaataaacgactgcttcctatcgtcagccaaatgctgtaagtcatcaatctcagccactgcgtcagtcttagcattcgccaaattttggttcgtcgcatcagtgacaattggtacgacatcggcaacattctcggcgttagcaatctgttgcttaaagtcggtctgctcatctgatgacaaataacttagattatcaatcgttgctgtgccatcgttttgtgcctcgaccaacgctgagtcagctgcctgctttgcatcggtgaccgcttgttcaactgtcgcgacatccgtcgcctgattgacttgattcgtatacgtcgtttggtcagtgtcagacaagttcgctaggttactaatctcagtcgtcgctgcttctttggcattggccaaattttggtcagttgcgtcatcaaccacggcgttaacccccgcaatatcagtcgcatctgaaatttgttggttataagccgacttctcatcgtcagtcaaataagtcatgttatcaatttcgacctggccatctgatttttggtccgccagcttatcagccgcctgcgcatcggcaacgatctgctcaatggcactagttgtctcagccactgaaacttgattatcaaatgattgcttcatatctgcatccaaattagccagcccagcaattgcaccatttgcccaatccttggcattcgccaaattttggtcggtcgcttcggtcacactctgctcaacatcagcaatcgtcatggcatcagctacttgttgctgagcatcatccttttcatccgccgacaagtacgtcaaatcagcaatcgctgtgtctgcgtctttttgcgcttccgccaacgctgccttatcagcgttcttcgcattagtcactgcttgttcaacagtcgccacatccgtcgcctgattagcttggcctgtatacgttgattggtcagactcagacaaattgactaagttgccaatctcagttgccgcgctttcttttgcatttgccaaattcgtgtcagtcgcttcgtcaacaacagcattaacacctgttgcatcagtcgcatctgagatttgttgcctataatcaaccttctcatcatcagacaagtaggtcatatcatcgatatccgcttgtgcatcggctttttgtgcagccaattcatcagctgctttggcgtcagctacaatttgctcaaccgcgtccgttgtcgtggcgtcagtaagttgatcaataaacgtttgcttctggttatcactcaagttctgcaaatcagaaatttcagtcgttgccgattccttagcgttcgccaaattttgtgtcgtggcatctgtaaccgtctgtgtgactacttcaacgtcttttgcatcagcaactgcttgcttaaactcagacttttcattcgttgacaaataggccatgtcatcaatggctgtttctgctgacgcttgcgcatttttcaaatcagttgcttgtgcatcggcaagaatttgttcaaccgctgcgacatcatccgcctgcgtaacttgattggcgtaatcagtccgctcggaatctgatagattagccagattgccaatttcagttgttgctgaatcctgagcgttcgccaagttagttgcatccgcttcgtcgacagccttgttcacaccggttgcatcagtcgattcggcaatctgattcttaaccgttgatttctcatcatctgacaaatacgtcatagcatcgatttcagcttgcgcatcagctttctgtcccgctaattcatcagccgctttggcatcagcaacaatttgctcaactgcatcagtcgcaactgcattagtaacttgctcaacaaacgtttttttctgactatcatcaagatttttcaaaccgtcgatttcatccgcacctgattccttagcgttggttaaattctgattggtcgcctcagtaacaatctgtgtcacatctgcaatggtcgttgcgtcggttacttgttgctcgaagtcagtcagctcatccgctgataagtacgtcaaatcagctatcgttgtatcagctgctttttgcgcttcggccaacgccaactcggccgcaccctttgcatccacgaccgctttttcaacagtcgccacgtccgtcgccttgttagcttgttctgtatatgttgtttgatccccttcagacaggttcgctagcttgccaatctcattcgttgctgatgccttagcattcgtcaagttattggcagtcgcatcagccacaatattatcaacatcagcaatcgttgttacgtcatcgatggtttgtgtcgcagttgacttgtctgtatctgacaaatacgtcaactctttaattgtctcagttgcttcagcctgagcatcctgcaatgcgctttcgtcagcaaccttcgcatcagccacgatttgttcaaccgtcgccaccgtttcagcatccggcaacttagaaataaacgactgttgtgcatcagtatctaagttattcaatgcactgatttcgtttgttgcccaaacccgtgcatccgccacatcagcattctttgcttgcgcaacaatcgcagcaacatcggtcaccgttttagcattggcaatctgattctcaaagtctgttttctcgtctgatgacaagtaggtcaacgcattaacagtcgctttcgcctcatcttgcgcatcagccaatatcgctaaatcagctgcatttgcgtcagcgacaatttgttcaacatcggccactgttttagcatcagccaatttatcaacgtacgttgcctgatcatctgatgccaagttaggtaacacattgattgctgttgttgcctggtctttagcattctcagaattcatcgccgtggcttgcgtcaccacgtcatccacaccagtgacagtcctggcattttcaatatcttgcttgtatccagccacttcttccgtcgacaaataggtcaacgcatcaatggtggcatttgccttcgtacgttcagctgccccaacggctgcatccgccgctttagcatcggccacaatctgttcaacttgcgccacagttgtagcagtcgacacctgattagcgtagccttgtttagcatcagcatccaggttaaccaacttggtgatttcatcattcgcccaagactgggcatttgccaaattttgatcagttgcatcagacacaaccgcatttacaccagccacgtcagttgcagtcgccacttttgctttgtagtcacccttttcagtggtcgacaaataagccatgccatcaattgcggtcgtggccgtcgttcgtgcgtcagcaagttcggttgcgtcagctgtttgggcagccgtaacaatttgttcaacttgctcggtcgttgttgcgccttgtatttgtgttgtgaaactttgcttcgaagtatcatctaaattcgttaggctagtaacttcaccagttccccacgtcttagcgtttgctaaattttgggctgttgctgccgtcaccacattattcgtatcttcaaccgtcgttgcactcgcaacttgttgcttgtatgcagccttttcatcatcggacaaataagttagcgcatcaatcgcagtattagcatctaactttgcttgtgccaactcatttgccgattgtgcagtcgtgacaatcccatcaatcgcatctgtactagttgccgcctcgacctgactcttataatctgcgcgttcggcatccgtcaatgcagtcaaagcatcaatctgcgcattggcatttgccttcgccgtcgtcaaatcaactaagacatcagttgaactggcaacaccagcaaacaaatcaagattaatcgcatctgagctcgcaattgctcccttaacttcgactggtgatgttgagccatccggcgtgattgtcgtcggaaccgtgaccgttgtactacccaaaacagcagcatctaccagctgattaactacatcaccagttccactagaaaggcttgaaataagtggcgttaataccgtgttcaccagtggcgaaagcactggatccaaattcacaacaccaagaacatcaatactcgttaacgtgttcaataaatgagttaacgtattggtaagcgttttgctcagtgccgtacccaacccgccatctaaatctactgacaggtattggctaccatctgacaacgtttttactgtcgcttcgctaggatcaactgtatagtcggctgtaatcgcaccatttttcaaagtgtctaatgttttattcaaattatcgaccacttcatcgccgataaccagtttgactgcggcgttatcaattaaatccaaaacgccttgcacaccgctaataactggatcaagaaccgtccccagtccaccgattacttcaacgtgcacttgaattggcccagctgcctcaatatccgtcccagccggcacctgcaatgccacttcacgagacgtatcgccaagtactgaaacatcagccgcaccacttgcatccatcgtgaaatcaacattagttggctgcccaaccggtagtgattccgttgcattcgatgtcgtttcgacgttcgtaaacaattgaccatccacgaccgctgcgtcagccgttctttggaccaagtgaacgccattgcgatcaaccgaaatatccggaaagtctaacgctacgcccccgcctaacgtcaaacaggaaatcccggcaatcacccacatcttcttggacttatacatccgcttgcgttgctcggatgtccccaaggctttgtctgccttattcatttttaaacccccactgttatatactctctaacgtgttccgacctcgtccctctcggagctcactcaccactccacaaggtcaatacagcttagttttaacacatatccagtagcggtaccaaagatagctatcgcaacggtttcacccaccaaaaacatgcgcaaaccgtgatgaagcgtagaaaaaaagcgttgcacaacgagaataattctcgttgtgcaacgctcgtatatcgacatatgccttatttttcgttaatgagctgtatcagtctattgcttcaataaaccgagcaactgcatctgccacaacatcacacatcttcacatcaacaacatccgcgttatctgcatccccgtgtaatgagtccatttgcgcaaaaacatctgccgacgtcaatgcaatcgcaggcacgcccattgcgacgtaaaccatatgatcacccattggccacggatcaacggttacgaattcctctccctgtgaaaaagtcttctcagaaacttccttaaagtcatctggcagttcatagtctgaatacgcaattttactaccgcgcatgccaataccatctaaattcacgacgattttatacgtggccgactcagctgctagtttttctgataccaccatttcacctggcatggcataattatcctcgccattcataaccacaaactctaacgccgacttaccgtgccaatccttcaatttttcagcaatcgccaataacgttgcaacaccactagcattatccagtgcaccaattgttttgggcgctgtatcaatatgggcaacaattgcaatcttctttccttcacccaaataaccaaggacattttcaccagtactcttagatcgactagtcttaataacaacctgcgcccgatggccactttgcagcttttcgccgtcattctgagatacgcccagaaccggtatctcaaaatcgccgtcttggataaccgcagtcggctcatcactatggctaacagaaataatcgcggccggttcgcctgattctaaggcggcaataatctgttgatgtgattcagggttatagaacgtaaagtttttcggcatcaacacttccgctgttaactcacccgtgagcacacaaattcgcccctttaagttggcagtttgcagactctcaagtgtatcaacaatcactaaatcaccaaccacatttactggattactatagtcagctgattgcaccagaatttcttgaccgtccacctttaatgtcgcaccgtggtcttcccagtccatagcatcaaattgttgttgctcaacttgataaccaagttctcgcaaaacgtcagcgacataagccgtcgcccgcttgttgccaggtgttcctgtcaatcgcggaccaatgtcagttgccaataccttcagatgttcttttattcttgtcatattaatcacctttctaaaatcagtttatccggtaaatttgtttatcttccggctaattccagagaagggtgagtcagaatgttgaaatacgacactatactaaaatgcatcagcacctcattaggcactgatgcatttttaacatagttattattgttccaaagcgccttcaagtgcaccaatcttcattgatcgtactggcgtcatcaaaaccttacctgtactacgataaacattgaccaaaccttcgccagatgcagctgacccaatcaaagacttaccagaacgttccaccgtgaaattcaatgagctagaccatgcaatcgctaaattgccgtcgattttcaaaacatcatcttttagttcaacttcaatcaattcttcttgtggtaccggtgactctagcgccgctacaccagctccaactaaactcaagttgaacaagccttcgccaccagccacggctgatgagaaattactacgcgcaaccaacttttgcttcaagccatcttcactggccaagtaaaatccgtcatcaatgacaacttgtccgccccactcagaaacatctaccaatagaatgtgcttgtacgttggttccagtgctagcatgccagttcccttatactccggcttaatcgcagcttcaccagtcaccgaacctttaatcatcttgcccaaaaagtcgccagcgcccttaataccagtggttgccttcacatcccccagcatccactgcatcgccccagcttgaattgtgacatcagcattttgcaagttaatcaacaactgcttcttcttaacattcatttgtgtcatgaagtattgcacttgtgcatcaaacggtgaaacacttaaatcacgttggaactcaacgacctgaaacgagcccttttcggcaatcactttaacgtcatcattggcgctgctgtcaagattatggacaggttttttcgacaccgcaaggtgccgctacaccgaaaaattttcaaaacccagatttcagcctaaaatggcgtgatttctgggtgtttttgtaggtggaacagggcttagccctgacgtccagagaaaacgagtgatatagattgtgaaccggccggatttcacaagttgtagcgtgcggtaaataagccttcacaaggcgaatttttgaaattcacaagtgacggcttataaactgtgtcgtaccggctggtgcctataaccgagattaagtaaaccagacattggtctaggcggcctgaagccaatcagtgcgtgagttgatgcgactattgttgtaccagttcacataccactcgacagacatccggacatcatcaatggtcctgtactcttcgtgataaatcatttcgcgcttgatgagcgaatggaagctctcgatactaactcaatttttgttgtttaacagaagttaaacgaatttactagcgaattgacttcgcaaatgtttttgcatcaagaactagcttgatgaccctacacatttgtttcatcgaaacgatattcagttttcaatgacctacgtcgttgcctcaccagacaacttatatatcataacaacctttcaagcgaatgtcaacaacttctttcaaagaagtttgaatatcaattagctattcaagttaaatatgttttgctgtttccctgaaacaacttaatctatattacatatgtttatgcgattcgtcaacactttcttcaaactttgttcatacaaaataaaaatcgcagccagaaaaccattctggttgcgatttcacttgctcttatatgtgcaattcatcaaagaatactgtggcatccccaataatttgttgcacccgatctggggctggaatccgctctaagttaatcgccagtaccggtacccctgctttagcgtactgtaatagaccagcgaatggatacaccacaaagcttgtcccaacaataacaatcaaatctgcctggttcacccacatggctgcttcttccacattaaatggaatttcaccatataacgtaatcccaggtcgcaacaatgcaccgtctgatcggcgcatattcgtcatgtactcagccaatgttgcttccttaccatcagttacagcataaatatcataaagcgatccatgaaattcaattgttgcttcactccctgccttcttatgaagaccatcaacattttgcgtaataatcttggcacgaccttgcttggttagcgccgccattttgtcatgaatcacattcggctcagcatccggaaaatacatattgtccatcatgaaccgatacatcttttcaggttcattagtcaatgcatcagtgcttaataaatattctggacgttcaactacgccactatcatcatagatgccacctttcgagcggtaatcggggatacctgacgcagttgaaacaccagcacccgttagaaagacaatctgctttgcattatcaaataagttttgaatttctggattaacactcatgctatgacactcctatctatttagtaactactgacgcacaacaaaaggttgtccgatttgttctagcacctcacgaacaggcgtttgatacaacgccttaaagaactcaggttggttctcatctggtgcagaaataacaaaactgttttgtccttctgacttgctcaaaccaacgtaagctgacttttctgtgttacggtctgtcatctctgtgtgcttaatatcgaatacttgagccaaaggcaaacgcaattggcgttctgatagtactggcgtcaacgttgcgaactcaagcgcttgcaattcaggcaagttccaagcaatcatttgcgcatcaaagcccttgaaggcagcaattaccgcgcggtgaaccgtgaatgggtccttgatatcatcaaccttcatcgtagcaaaaatgttacctgcagcttcccatgattctgggaaggcatctgcaaagctatccgtataaatggctgtatcaatatcagatggcacggcattcatgaagacgcgtgcatccaacaacgtcaacaaacgtagcgctgcttctgaacgatcattctttgcttcaggcgtcaacgttgacatgaccccgttcgcaaacgcctttacaaccgccgccgtcaccaaaccgtgcttagcttgttccttataagtaatcgcacgcaaagctggttggtaaaggtacgtcgacataaccatcaattgatccgtcatattaatatcttctgactttaattggaaatacacttgtgggtaaccgctcaacgtcaacatcatgttcaacaattcttgcgttgctgagaaatcaggtgcggttgcatcagttacctcaaccatcaaacgcgttcccaacatatccgttgaaacttggtcatgtgtcaacttacccgttgcttcacctgaaccgcgaaggacaactgaacctgggtaaacttgattaacttggtttaggagcttaactgtatcttctgaaaattgcataataatctctttcttattccttatttactatgacgtaatgtcgccaacgtttcacgggcaaccgtttcattgaattgtccaatttgttgcaaacgcgctgttagcgcaggtacttcttctgtcgtcgcaccaacctgcaaagctaacgacttcgcctgcaaggccatgtgacctgcttggatacctgttgtgactagcgcgcgtaaagctgacaggttttgcgccaacccaacggctgcaacgatactcgttagttcattaaccgtcggattatccatcaaagcatggttcagcttaactgctggtacaataccaatcgatccaccaacaactccaagcatcaatggtaatgttgtctcacccaacaacatatcatcttggactgtccaacttgttaaaccatgatattggccattgttagcagcataggcatgcaacgctgcattgactgctctcgtatcgttgccacttgccaatacagtcgcttcaataccgttaagcaaccctttgttcgacgtgactgctcggtaaggtgacaattgttcaacatgactcgcaactgcaattttgcgagcgacttccgcaccaggcatcccctgctttgttgccaacgcgtctaccggtattgcaacacgtgccttaacgagtgcctcagttgcatagttggaaagaatcgccatcaacacttgataccccgcaatggttaatttctcagccaccgcttcagacatagtattaacaacgtttgcccccatcgctgccttaggatcaaccaacacatttacaatggctgtttgttcatctaacacttctaccgttagcgccttggcaccaccaccacgcttggccattgatgggtgggcatcattagcagcttgcaacaaagcttggttattacttgaaacgtattcttgtagcgcatccacgtttgctacatcagtcaaaataacctggccacgtagcaggcggctttgaatcgtcgttttaaccccttcgccagcgcgcatcatgcgagcaccattacttgcagccgcaatgacgctaggttcttcggtactcattggtaccgttaccaatcgaccatcaactggcaaatctggtaacaaacccgttggcactccaaagttgtaaagataattttcaacctgttgttcaccaactgcatcgtattgcgcttcaatcaaagccacttgctcagcagtcagttgcttattttcaatcgttttatctagtcgctctcgccaagacaacttataaaaaccgtgccaatctgccattatctaaagtttccttttctaatatctcttatagtttaacagttattttcaacgtttaaagcaaaaaacggttttggcaatcgttaccaaaaccgtctccattattcttcaatcgtttgtacgcggtacttcaccacgttttgatcatctaccgtcgcaaacaagcgttgtgtttgttccgcatcaaaaaatcccagatcaaccgccggaatgccatcaatttcagcagttccttgcacagctcgactcataacatcatgcaaaaccttccatgattgctcaagctcttccttcttctttacggcagccttcaatgtataaccttcatctaagaaattcttgattgtggccactgcgacataagttttgtagttataaacacgcgcatcttgttctccatcacgactaagcgacgagataatgcccttgctctcccaatagcgaagttgacgagtcgaaacaccagtcatcgttgctaactcaccaatacgaaattggaacacttcagacttcaaaaagttcttatgaaattgttgctttgatacaaacgtcatcgtctcgccctcctctcattttgccgtttattattgtcaggttatttaacataaatgtcaaggcgcgcaaaccgctttactctcaaaaaaagacacccagtaattaactggatgtctgagatgctttagctattcaattatgggtttggtgcgtcatccccaccatcggtcgaatcgccaccgtccgggttaacctgcttgatacgagacgtatctgacctaggttcatccttttctggcgcatcagttgtataaagtgactgcgtcgtcttattatcgttttctgtccaaagactagttgagccaacacccttttggttttctaggttctcaagcttccccaaaccatttgcatagttgtacttagaagcatctaccttagagaatccctttggtgtgtagaaacgtagcaagtctttctgattaatatcgtcagaaattgataactgcttattaaccttcttgcgcgccgctgctacttccttttgaacttgctttgatggatcgctaatgacctgtcctgtcgtgttgtcatagattgtctcgccgattaccgtgtactttggcgtaataaagtccttatcacggaaagcaacgacctgatcgcgctttgtactcaacaaatcttggccaagttgaacatcattcttagtatcaacacccaacaagtgtagcaacgttggcatcacatcgatttcaccaccatacgtgtggttaataccgccacctgtgtatccaggaatatttaccatgaatggtacacgttgcatttgtgcattatcaaaatcagtccaatcatccgcactctttcctaatacagaggccaatgacttgttttcagaatttgagataccgtagtgatcaccgtacaagacaataattgacttgtcgtatagccctgacttcttcaagtagtcatagaattcaccaattgattggtcaaggtagtgattcgtttcaaagtaaccattcaccacgtcagaatcggttgtcgttgtcacgaagttcggatccttatcttgttcatcaagactgtatgggaagtgattcgtaacggtaatgtacttggcatagaacggttgttgcatgtgctccaggtatggaattgaatcatagaacaacaacttatccttcaagccatagcccatcgccttatcaccagacgtgtcatagtaactagcatcaaagaagtattggtaacccatgttcttataaacattactgcggttccagaaactagcattgttaccgtggaagacagctgatgagtaaccctgcgtttgacgcaggatagctggcattgcttggaacgtttgatcattaccttgtgtggcaaacaacgatccttgtggcaaaccaaatgttgatgtctccagcatgttttccgcatcagacgtctttccttgaccaacttgattaaagaaattatcaaacgcaatggttgagtttgaattgtaaattgcattcaagtttggcgtgacttcctgcccattgatttttaggttcaatgagaattgttggaacgactccaagtgaatgacaaacacattcttaccctttgcgataccggcatactgtggatttgaatccgcaaagtgtccctttacataactcagcacattatcaatatcagatttcttagctgacttacgcatttcagaaacaccatgcgtcttaatcgcatcaaatgcggtgtaagcatcaataccaagatacttaaccatcatgttgctatcaaattgacgtgtaatcaattgtggacgatcagcttcacccagcgtcaacgtcaccatgaatgcgaaaatcgaaaatgtcgtcatcgcaaaactcataaacttcgtcgtgccctctttttgaatgcgcatctttttaaagatgaacaacccaataataatcggcacatcaatccagaagaaaatgtcatggatattagttagtgcaaaacccgaagctcccaatccttggttaaccttgttgtaacccagcatcgtcgcaactgacataaagtccgtgaactcacgatagtaaatcacattcaactgaatcatcagcacgttgactacatataaaatcgtcgcaactggataaaataactttgctgatcggaagtaaaacgctaacccaatcaacaatgttgatacagttaacggatttagtagcatcgtcacatactgaaccggcgacgctcccgaatacaagtggaaatccatgatattggctaactgtgttttagcccaaaccaatgccaccagcagcaaaacaaaccccaagcgggtatttacccagctgaaacggccataatgcctcatatacttcactcttttctttttatcgttagattttaagtttcaatcagccaaatttagactgcatctgccctattatagcgtaatttttaagttcataccttatagtcttctgtttaacgtaatttgcgctaaaatagtttgagtattgttgcacgaatttacccagaggtgatcagtccatgtcaaatgaactcattgtaagtaaagaatacggtgctggtgcacttagccgtgaagcgcttgctatccgtcaaaccgttttcgtcggcgagcaatgtgtaccgctcgaactagagattgacgacttagatgattctacaacccactacgttggctttaccgaaagccacgcagtaaccacagcgcgtgtcttagtgaaccaagatggttctaactggcacattcaacgtgtcgcgaccctatctgatgcccgcggtcacggttacgctgcaaaaattatgcaagaaattattgcggatgccaaagaagctggtgtacacacccttgatttgggtgcccaagtttcagcacttggtttctacgaaaagcttggcttcgaagctgaaggtgacgttttcctagatgccggcattgaacaccgcaacatggttctaaaactttcataaagcagacaaaagcaccgcaacgaaattaatcgttgcggtgctttttcatatttattatttaccttcattgatgtgttgacggtatgacaacacaggaattgaaaattcgctatatgagcggcgggcaatgaatgaatagattggccagaagcgttcatcaaccaagaattttgctgattcagttgcttgattccacaacgcctcagcagcttcatcatcatcagccaatgacaattcaacaacttgcgccatcttcttaacgaagccaaagtatgtgctcaaagctggcaaacggtactcacgcaagaacatcaatgtattgcgaaccgtttcatcatccttgttttccaatgccataatcaacaattggaagtgcaacaaagccacgttacgcacttcagctgaagagaagttgtccaactccatcaacccatatccttcaagactagccatacggcgtgcttgatcagacatttgctttacgacaagcttagctgcgttgtatggttcgtggcgaataatgtttgcgaacatcaacatgtcatttgctgtatagaactcacgtgatgagagcaacttaacgattgttgggcgaaccatttcaatcaaacggtacttctcaacttcatcaaccacttgagagttaattgcacgtaccaagttaactagcaaacggacatcgcgcgtctcatcatacattgaaagtgtacgataaaccgtgtcttccgttggcgtcatcgtaactgagtgcgcgtccaaaccaagttccttaattgctggatccaacaattcaggattattcatatagatgtggagcatcaattcatcaaatgacacaccaatcgtcatcaacaaattcaccaacgttgttgcactgacttttccattaccttgcaagtagtcgtacaaacgtgagcgtgaaatatcaaccgtcttcaaaacaaccggaactgaaatgtttcgttccttgatgaaataaatcatcgcgtcacgaattgcatccaccggcactcgattcttacccatataaacctcttacttatcgttaacttttctcatataaccacccataagtatactcctctacataatgtaagtgtgatattatgcaaacttctttgtcccacagatgatacattcggattataactacacgtcaaagtcatataatttcattattattaattactattttagtatattaatcagccaaataacagtcgatatctataaatcaaaaataacaattcctaaatattagacagatgcatatatacaaaaagagacatcacacagtacgttgtatgatgtctctttatttttactcttgtgaatctgaatcgtcttcagcacgtgcgagtagctcagctacttcagctggttgttcaccagctgctggtgcatccggcaaatcagtgccagcttggtcaacaactggtgtcgttgctacaccgtcttgcgttgcatcttctgactcatcttcgtgttcaaccttagcgaaggttgccaccacagcgtcatcatccaaacggattacgcgcacaccttgagttgcacgaccagtttcagaaactgaatccaccgtgaatcgaatcataacacccttgttagtcgtcaacatgatatcttctgatccgtcaacaaccgccaaacctgccaaaggtccgttcttttcagtgatttgggctgtcttgatacccttaccaccacgacccttgattgggtattctgagactggcgtttgctttccgtatcccttttcagtgataaccaaaacgtgaccttcgtccttcaagacttcagcgccgataacaaagtcgtcgtcacgcaatgtaataccacggacaccggctgctgaacgtcccattgaacgaacggcttccgcattgaatgaaacggcataaccaccatgcgtaccaatcaacaagttctcagtaccatcagtaatcataacgttgatcaattcatcatcatcattcaacgtaatcgccttcaaaccgtgggcacgaatgtttccaaagtcagataccggcgtcttcttaacacgtccaaggcgcgtcgtgaagaacaagtaatccttgctttcggcagcatccccacgcacgttgatgactgtttgaacactctcaccagcttcgattccaagcaagttaacaactggaatacccttagctgaacggccgtattcagggatttcatatcccttcatcttgtagaccttaccagcgttcgtgaagaacaacaacgtatcgtgtgttgatgtaccaatcaattgatcaatgaagtcatcatcgttaacacccattccttgaacaccacgaccaccacggttttgggcacggaattcagtttgtgccatacgcttgatgtaaccaccactcgtcaatgacacaataatgtcttcttcttcaatcaaatcttcatcttcaatgcttgtcacgtcaccgatttgcaattccgtacgacgctcatcgccgtacttctcttgaatttcaagcaactcagtgtagatgatttcgtcgattcgctcaggcttagccaagatatccttgtagtcagcaatcgctgtcatcaagccttgatactcttcttcaatcttgccacgttccaaacctgtcaaacgaaccaaacgcatgtccaagatggcttgtgcttgcttatctgacaatgcgtaatcagacatcaaacgattcttcgcaatttctgacgtttctgaaccacgaataatgctgataattgcatcaatgtgatccaacgcaatacgcaaaccttccaagatgtgcgcacgtgcttcagccttacgcaattcgaattccgtacgacgacgaaccacgatttgttggtgctcaagataagcaaccaacattgccttcaagcccaacaactttggacgaccatcttgaacggccagcatgttaaagctgaacccagtttgcatcaacgtgttcttgtacaagttgttcaaaacaactgaagctgaaacgtcacgacggatatcgattgcaatacggtaacctgtttggtcagattcatcgttaacggcggtgataccttcaatacgcttctcacgtccaagttcagcaattcgctcaatcaactttgccttgttaaccatgtatggcaactcagtcacgatgatgcgttccttaccagacttttccgtttcgatttcaaccttcgcacgaaccgttacgacacccttaccagtctcgtacgccttacggataccagactttcccatcacaatcgcaccagttgggaaatcaggtcctgggacggcttccatcaactcagcagttgtcacatcagggttgttcatcaacatgtggatagcagaaatcacttcacccaaattgtgaggtggaatgtttgttgccataccaacggcgattccatttgcaccgttaactagcaagttagggaaacgagctggcaaaacaaccggctcacgatccgtaccatcgtagttatcagcaaaatcaatcgtatccttgttgatatcacgaagcatttctgtcgcaatcttgctcaaacgcgcctcggtataacgcatggcggcagctgggtcaccatcgacagaaccgaagtttccgtgaccatcaaccaacatgtaacggtaactaaaatcttgcgccatacgaaccattgattcgtaaatagcagagtcaccgtgggggtgatacttacccataacgtcaccgacgatacgagcagacttcttgtgttgcttatcaggcgtcacacccaattcgttcattccgtacaagatacggcggtgaaccggcttcaatccatcacggacgtcaggcaaagcacgagccacgataactgacatcgcgtagtccaagaatgacgttcgcatttgctcgccaagcttggcgggattaatgcggctgttattttgttcttcttcagccatttttgttcctttctagttgtttaacgctgtggctaacacaacattaaacgtccaattcagcgtattgtgcgttctcttcaataaactcacgtcgtggctcaaccttgtctcccatcaacattgagaatacttggtcagcatcaacggcatcgtccatttcaacacgcaacaagcgacgaactgatgggtccatcgttgtttcccacaattgctccgcgtccatttcaccaagtcccttgtatcgttggataacaggcttaggtgatgcaggcaacgttggcaacaatgcttccaactcttcatcagaatccaagtattgaacaaacttaccttggcgcacttgatatagaggtggttgcgcaatgtagatgtatccagcatccaacaatggacgcatgtaacgatagatcaacgtcaatagcaacgtacgaatgtgcgcaccgtcgacatcggcgtcggtcatgataatcaacttgtggtacttagcctttgtgacatcaaattcgttaccaaaaccagttcccatggccgtaaatagtgaacgaatttcttcgttggccaaaatcttgtccaatgaagccttttcaacgttcaaaatctttccacgaattggcaaaatagcttgcgtcaaacgctcacgaccttgctttgctgaaccaccggctgagtctccctcaacgatgaacaactcagaaatttcagggtcctttgacgtgttgtcagccaacttacctggcaaattagcgatttccaaacctgacttcttacgcgttgcttcacgcgcacgcttggcagccatacgagccttaccagccaggatacccttttcaacaatttgcttagcaactgctgggttttccatcatgaaacggttgaatgtctctgagaacatacggtcaacggccgtacgcgcatctgagttacccaacttcgtcttagtttgcccctcaaattgagggttagggtgcttaactgacacaatggccgtcaaaccttcacgaacgtcatccccagaaagggcatcatcgttttccttcaattgaccattcttacgtgcgtaatcattaattacacgcgtcaaagcggccttaaatccagtttcgtgagttccaccttcgtacgtgtggatgttgttcgtaaatgacaacatgttgctgtggtaatcgtccgtgtattgaagtgatacttcaacttcaatgccattttccattccctcaacataaataggatcatcaaaaatgacatccttgttgacgttcaagaaacgaacgtattccttaataccaccttcgtagtggaatgactctgtttcaggctcatccgcacgattgtcagtaattgaaatacgtagtcccttgttcaagaaggccaattcgcggacacgattcatcaaaatcttgtaatcatatgttgtcgtctcgcggaagatatctggatctggcaagaagtgcacaattgttccacgtgaaacaggtgcgttatcaactggtgcactgtgcatcgttgtcttaacgtgaccacgttcaaagtccattgcataaccttgaccatcacggacaaccataacgtccaattcagtagacaaggcgttaacaacagacgcaccaacaccgtgcaaaccaccagaaaccttgtatccgccaccgccgaactttccaccggcgtgcaaaacagtgaagacagtttccaaagcaggcttacctgtcttctcttggatatcaacggggattccacgaccgttgtcagtaaccgtaattgagttgtccttttcaattgccaccgtaatgtgatcagcaaaacctgctagtgcttcatcaattccgttgtcgacaatttcccacaccaagtggtgcaatccttgactcgtcgtcgttccaatatacatacctggacgcttacgaacagcttccaatccttccaaaacttggatttgactggcatcgtaatcatctgcgtcagtatgcatttgtgttacatcttcttcagccatgagttcctccttaaataccactagtctgcactagcttcttcccctaaaccatttgtttcaaccagttgcccggctcgcacattaaagacctttggttcattaattagttgacgggccacatcacttagtgacggcgtcgtaataaaggtttgcaccttattttgcatcgccgttaacaaatgtgtttggcgatttgtgtctaattctgatagcacatcatcaagcaacaaaatcggatattccccggtttcttgcttcatcaaatcaatttccgctagcttaacagccaacgcagtcgtacgctgttgtccttgtgaaccaaacgtcgccacatcatgaccattcacgtcaaaacgtaagtcatcacggtgtggccctagcattgtggttcccatcatgatttcacgtgattgtaaccgctcaaaacgcttcatcatggcagacttaaccgtctgttcatcaaccaattcttcttcagataattgtgacacataagcaatcgaaagggtttcgccaccttgtgtaatatctgcatgaattggtgcagcagctttaccaagctctttgatgagtgcttggcggcgcatgataagttcgctagcaaaattagttaattgctctgttaaaacttccagatacaagacatctttggcttgcttggattgcaattgcttcaaatactgattgcgctgtttcaacacaactttgtattgatttgcaatatatagatactttggactcatttgactgaattcgcggtcaataaaattgcgtcgcacagtaggtgcaccttttaccaacgccaaatcttctggcgcgaataaaataacgtttaattgaccaatgtaagtacctaactttgcttgatccaagtgattcatgcgcgctttcttacctttactagtgaaagctaatgaaagtggcacttttccgtactgacgttgtacaactccggaaaccatcgcttctttgccttcccaaccgatcaactctttatcagatgttgttcggtgcgaacgtgccaaagctaaaacataaattgcttcaagtaagtttgtcttaccttgcgcatttggtcccaggaatacatttacaccaggcgaaaatgtcacctctaaatcttgataattccggaaattattcagttttagctcaagcagttccattagtctgcttcagcacccatcccgttaatcacaaagcgctcaccggatggtaccgccacgatgtcgccagggtacaacttacgaccgcgacgatcatcaggttcttggttaacaagcaccgtgttctcacgtaggtaccacttagcttgtccacctgttgagataatgctttcttccttcaatagttgccctagtgtaataaagggcgtttgaatatgcacttcagtagccaattgcattgtcctttctgccgaaaaaaatccagctgagaaatgtctccataagtaaatctattatacgctattttctagcattattcaatgtaattccggcttcagagggcgtctgagcggttagagattaaattaaacaaaaaagccgaaaatcgctgttttttcgttaaacggcgattttcggctttttaaatcattttagtaagtacgaactggcgtaattagttgaatgaagtttgtttcgttattagttggtaccaatgtaaatggatccaaagctgtcttaaagccaatttgaatttgctcatcaccaaatgacttcaatgcttcacgcatgtagtcagggttgaatgaaatcgtcaattcatcaccagctgtttcagcagcaaagatttgctcttcaacgcgaccaacttcaggtgagttagaagaaatcaatgacttctcatcgctaaccgtaaattggataacgtttgaacgaccttcgtgactcaacaaagcggcacgttcaatcgtttgcaacaagtcacgtgcgttaatcgtcaaagtcgtacgcttctcagttggaatcaaacgtgacgcatctgggtagttaccttccaacaaacgtgagtagaacgttgtgttggcacccaattggaaaataacttggttttcggccacacggacatcaactgtttcaacttcatcaagcatcgcttgcaattggttcaatgaaggacctggcacgatgatatcagcatcaacatctgattcgctcaaagcgacagtacgttgtgccaaacggtgacgatcagttgcaacggcagtcaagtttccgcctgccaagataaagtgcacacctgtcaaaataggttggctaagttgctttgaaacagcgataaccgtttgaccaattacttcgttcaacgtttctgatggcaaagtcaaatcgttgcgcacttcaatttctggcaagtgtgggtagttattagcatcttgaccattaatatcaaattctgaattctctgaagtgatctttgcttggaatccagttgtgtttgacaacgtgaatgtttcacctggcaaacgcttaacgatatttgagaagaaggctgctggcaaaaccaatgcacctggttcttggattgttagtgatgcttgatcatctgtaactggaatcaacgtttcaattgagatatctgtatctgatcctgtcaacgtcaaaccattgttatcgagaaccaacttaacacccgttaggattggcattgatgtacgagatgaaatagcacggctaacgttattcatagccttgatgaaaacagctcgattaattgtaaattgcatgataatctcctcaagctttttttgctcggcatgctgcgcatgcgtcgccttaatgactgatttatttataaacaaaaagataataataataataaggggtgtgcatactgtggaaaaggtcaaactagaccattacaccaaggattggtctatgtatacaaacctgtggaaaactttttagtagttcgtgaattattcacaataggtattgatgctaattgctcaactcttcacgaatttgttgaacttggccagctagcacggcgtcgttttcaatcgcattctcaattttttcagttgagtgcatgacagtcgtgtgatctttaccaccaaaagcacggccaatttgtggcaatgagtcttgggtcaattcacgtgcaatgtacatcgcgatttgacgtggcaccacaatttccttattacgcttcttaccattcaagtcttgtactgtgacgttaaagaacttagccactgtttcttgaatgattggaatcgtaatcgcacgttgacgcttgaagttcatagtctccaagatatcgcgcgctgtttcaaccgtgacaggagccgttgcgaatcgcaacttaccagcaacctggttgaaaacaccttccaaatcacggacgttcgtatcaacggccgctgcgatttcatcaatcacatcgtttggaatgttgaggttttcttgctcagccttattacgaaggatcgcaacacgagttggcaaatcgggcttcgtgatgtttgctgaataaccttgagcaaagcgtgtaaccaaacgcatctcaagaccagggatttccttaggcaacttatcagatgtcagaacaatttggtgattctcacgcgtaattgcattaaacgtgtggaagaattcttcctgaatcttgtccttatcagctaagaattgaatatcgtctactaatagaagatcggcagaacggtattcttgtttgaatgcttcagtggcattcgcaccacgacgcaacgcatcagtgaagtcgttgataaagtcctcagtcgtgatgaactttacctttgcactggggttgcgctccaaaactttattaccaatggcttgcatcaagtgggtcttccccaaacctactcctccatatataagaagtggattccattgtgtaccaggattgtcggccacggcttgtgcaacagcgtaggcttcaccgttttcgtctgaagacacaaacgtttcgaatcggaattctggattcaaaattgattgtgtaacgaagtcagatgctgaaatctcaacatttgattgcggttcagcagctggcgcagttggtgtttcctcaaataatgaggttggttgtggctttaggaacgtaacagatggaatgacaaatgttggtgtgccattcactttgtttgtcgcaatcattgccgcttgaatgaatgcttgattgtaagaactattggtatcttgccattcttcagcaacctgctcgtgattcgttgcaagttgtaaagtcagcgtgttgttctcgttttccattactgctactggcgttaatgtttctacgtagttagcataggaaaaagtttgtgcgattgtggcacgcagttcttctttaatggcgttccaaagttggacaggatccatttggacgacctccttaaataacaaataacggtatcggaatctttgggtggaaagttttccacaatacgttcgtcaaaattaatgaaataattaagacgcaattcgacaaattccattttagcaggttgtggaaaagttttccacaagtaatattgcctatgtatcaagggttaccgcaatttccaataacattttgtgatattaacaccctgtggaaatctaaatttaggttatcaactcggtgtgaatttgaaaaacgaggtttctgtggaaatctgtggataagtcgcctgattttgagttatttacaaggatttgtgcaaaagccagtgcatataacacaaggttttcgggagttttccacatattcacaagggggttgcgactgttttgtacaaccatgtggagaatgtggaaaaaatgtggatattggggaaaactaaactaacaggctgttatattgctgatttttatcaacataacgctccgttactttctggaaaactcctgcgacttttaaatttaaattttttaaagaaattgttaagcactttagaatttgacggtggatctgtgaattttagataaactatttgtaagctgcttttcttaatagttattaaaaataaataaagtgctttagaaagcttgctaagtagatagttacgtgataaactgaaatacgaattgtggtttggccttgccaaccgcaggccaaatctaactacgaatgggaggtgtattcacatgaagcgtacataccaacctaagaagcgtcaccgcgagcgtgtacacggcttccgtaagcgcatgagcactagcaacggacgtaaggtgctagcacgtcgccgccaaaagggccgcaaggtattgtcagcctaattaggtcaggccttctattaggattactgataacgatcgcgcgtggttcggccattttggctgaatcacgcgttttctattgtcttcaaaaaagtctggagcaaacatatgcgtaagagttaccgtgttaaaaaggaagctgatttccaattagtcttcgatcaacatcactcggtcgcaaacaaaatgtttattgtttacacgatggagcgtgaacaaccaacccacttccgcttgggaatctctatttctaagaaggttgggttgcgtggtcatgagcgtgtatgggttaagcgtcgtattcgtcaaagcgttttggaatttaagccaaacttgcgccaagatgtcgatatcttagtgattgcccgtccatcagctcatgaccaagacatggcgatcatcaagaagaatttggaacacgtcttcaagttggcaaatttgtttgtcgatcaagacgaaaaataaaaactacatattatatggagaaaatcgatgcagtctgctaagaaagtattttcaacgcgttctacagttaccgcagctatcgctttaatcattatgattatcgccggtgtgatgtttaagggttcggtttcagggtctggtttctggcatggcgttatcatcgccaacttctcacgctcaattttgggtgtgtcagcttggtttggtaacaactatggtttgggaattatcgcctttacgctattgattcgtcttttgattttgcctttgatggtatatcaaacgcaatcaatgcgtaagatgcaagaagttgcccctgccttgaaggctatccaagcaaagtatccaaatcgtgatactgagtcaatggctgcaatgcaagctgagcaaagtgccctatataaggaagctggtgtaaatccattcgctagtttcttgcctttgattgttcaaatgccaattttgattgccttgtatacggctattcgtacgacgaagcaattggaaacgggaactttcttgtgggcacaacttggtcaacacgatcacttgttcattttgccaattttggctgccctattcacgttcgcttcatcatacttggttatgatgggacaacctgaaaagaacggcatgacaacgtcaatgacgtacattatgccaattatgattttcatttttgccattaacgtaccatcagccttgtcattgtactgggtggtctcaaacgccttccaagttgcacaaacatggacgattcaaaacccatttgaaattcgtcgtgagcgtgaagctaagaagcgtgccgagaaggatcgcgaacgcgccatccgtaaggcaaagcgtggtcacaagcgctaattattaaagacaccgcaattattgcggtgtcttttttgctaccagtgaatgaaccttgaaaaaatctgaacgttttgtaaaggcgcttgttattgggacaatttttcatggtaggtgtgctaaacttatgggtaagaaacatatatgataggagaacacccatgaaagcatttcgcgagattatgtcttgggttattccgattgctatcggattaattattgcgctcttgattaagtcttactggtttacgttggtccgtgttgacggaacttcaatggaacccaatttgacgaacaacgaacgcgtatttgtcttgaagccagacaaagttcaccgaggaagtgtcgtggtatttgatgcttatggtgaagatccagaagttgatggtcacaaggactacgttaagcgtgtaattggtatgcctggtgacacagttagcgctgtgaatggtgttatcaaggttaacggcaaggttgttgatcaagatttcattcctgaatctgagcaaacggcaacgaatacggttaacaacgttggtaactggtcaagcttgactgaacttggtgaccacatgggttggcaacgtcaaaagacggttaaggtgccaaagggacaatacttcgttcttggtgatcaccgtacagtctcaaacgactcacgttactggggctttgtcagcgaagacaaggttctaggtgttgtgaaggtgccgttctggggtaacgcagaaaagaaggccaacattaacacacaatggaagactttctttgagaagtaattaaaaatgcgactagctacgtgctagtcgcatttttttataccggtaagattaatatttggtcatccacagacacaattttgagtggcgtttggaaagccacggaaagtttggcctcatctagcaaagtttgcttgtcagcagttgccaattcgcccgatttattgagtaaccaaatggcatcactgtaagtaaacgcctgatttaaatcatgtagtaccatgacaaccgttaaacggcgctctttttggacgcgtcgcaatgttttgagaaagatttgctggtactgcaagtctaaatatgtggttggttcatcaagaattagtaaatctggcgcttgatgaagcacaaaggccaaccaagcaagttgctgttgcccaccagatagcgtcatcatattttgatcaagcagcggttttagttgtaaatcactgatgatgcggttgtctaagtctggttgtttaattgttaagagatcacgaacggtcagtggttcaaacaattcgttcttttgtgcgagtaacgcaatcttcgttgggcgctctgtgataaagccggccgttggctgtaagtcatcggtcattaattgcagcaaggttgtttttccagcaccgtttggtccaatcaatgttgtaatgtgatggggttctattgatgctgaaatatcattcagaatacgtttatcatttcgattgaatgaaacttgattaaatttaagcatggcggccacctcggataagcattagaacgaataatggaccgctaattgcgagtaagaccgcgcttgttgataattcttttggtgccaaaacggttcgagcaattgtatcggcgtttagtaataataagctcccccataaagcggtcgaaacgattaattgttgtgttttcgcttttggtgccatcagtcgagcgatttgcggcaaaatagcccccaagaaaaagacgacgccaattaaactagttagagcaccaatccaaataccgatggcaattaggacgaaccacattgtccgtgattcattgattcccagcagacgaacttgctgggatgataaggcgaaatattttaaatgatgccaaaccaaaagtaataagatgctaccaactaaaacgctaatggttagttggatgacttgtagccaagttacggtgctaagcgtggataatggcagaccaaagccttcgctggcaatgcttgtgcctgcctgaaaagtcattgcggttgcaataccaattaaaatgagttgcaagttaccccgattagttggcataaccaaacgccagccaatcatgataataataccggcgagtgcgccgaaaatgacattattggccaatacgctcggtactaaaaccaaaaggcctgtggtaaaaaactgactaccattcatcatgcctaagatcgaggcatcaacaaatcgatttcgtaagacgagctgtagtaacaatccgctagcgccgatgatggcgccaccgataatgctcacgataattcgtggcaatcggtaagttatgatgagatgccaggcttcactgtttgaaaaggctggcaggtcagtactaccaaccatcaaagcgatgataacacttatgattagcaaactaagcaatagccagttataaagatgtttcataggcatcccttctatttgtctaaccaagttttgagttggttaaaagcttttggcgcatttagattggccgtcataccaaaaatgggttctttggcttgatagacatgcccatttttcacagctttaatggcttgccaattgttttgcgcaaacaaagcatcaaaacttttaaaaacattgtcgggcattgcatgcgccatggtaatgatgacatcagggttctcagcggcgatttgctcagcgttcaaattggtgtacgctgagtcgcctgtaccaataacatccccaccagccttggcaattaagtcaccgacatagctgtgttgcgtaccaactaagaaagaccctcccggcatccccatgagtagtgcaacttttggtcgtgacgactgcttaactggcttaatcgtcaattgtttaactagctgacttgcttcagtttgcttattatattgcttaccgacagttgtgatgctgctttttaacgtatcaagtgttgaaaaatctaatgtctgcgtggcaatatgatcactggctagcttttgctggtagtcatcaactaatgcgctgtctaagtagaccacgtcaggttttagtgatgacatcttttcaagattcggtgcaacgtgattaccaacttgaggcaatttcgcatatcgttttggcaatgtttgttgctcaccaggtgtgggtaccccaactaaggggatggctaactgatcaaatacttgagcttgcgcatttgtggtgacaattatccgttttgtcggggatgacgtggtattagcgggattttgcgacactaaccatatccagccaccggctaaaacgagcagaataataaataggatacttaatccagttaattgttttttcgacatagtttacttcttctttagtagatttagggcaattgcactggcaatcccaataactaatccgccaccaatgatagccgcaattggcaaaggtgtttcacgagttactgacttagatggcacctcttttttagtcgttggggcttttttcttagcgctagaactggttgaagctaccgaactgctagttgatgaagcacttgtctcaacgctacttgaggtaattttcgaactctcagatgaaactgttacactggttgcgcttggttggtgtgacgtgccagcctcgcttgacgcagcaggactactttgtgcgacagattctgaagcaactgtcgccgtttgtgttgctggcacggatgatccatcaacaactaacccaactgtgtaattgtggtgatagttaatgttatcaacatcaacacgaatgttggcgttgtgacgagctgccaggtcatttgtgtagaaagtataggtaattgtttgattttttcctgcttgactcttagcaattgaaacaccagcaccatcaacacttagcatctgtaccggatagtttcccaaactggtatcggtggtaattgttgaggtgatggcataaccattatcactgggtgtaacagttgccgaaccggcaaaataagccgctgcgtaagacgttttatttgtaccattctctaaaatttgcattggaacggtgtaactgtctgcagcaacaaaataggttggtgtcaaaatggcagttaaactaagcgcgacagtaatcaatatttttttaatcattattttggtgatttctccagacgtttaggccgagcgatgtgccaacaaaaccaaaagcggttgcaatcgaagcgccaagggcaatcataacggcattcatcttagaatgtcccgcagtcaccgtaacttgtgcttgatggttagtgctattggtcgttggcagttgcttttgtgcgacatgaattttaggttgttttttctcggatgtgctcttttgagttgctgattgcgcctggtttgtagtcgctactgtgtgttgtggcgtcataacggctgattgtggcattacatcagccgacgccgaggttacggcattggcatctgtagtcgcgatgcttgcaacagacgccgcggtgctggatgacgttgtgtcaggcgtacccgcggtactaatggcagtgtttggtgctacaaccgttggcttatgatcagcaacaggattacttgttgctgatgtggaagttgcgtccgcgttatcgccaatgattaagcgaatgctgtaatagttgtcgtaagacattggttgtgtaaacatcacgtgaatattagtcacaattggcgctgataattctgatggtgacaatgttagacggataactgattggtagaaaccattgaccaattcagtactgataaccttcgcatcgtgtgctacatcattgaaagtaatcggtgattgacccatcatttctggcgtgtgcgttgtaacgaaagcgaagtaagatccatcggcatttttaactaacttaatcgtcggtaacatgtaagtggccgccattgatggcttgtcattatcggattgcataatagttaaacgacgcatttcctcggtgacatccgtctttggtgtgtcaggctttgttatcggcgctgtagaagagttctcagcctttttggaactagaagaactgctaatcttggaagattcagaagaactgttagtcatctcggaactagcagaactactgattttagaagattgggaagaacttttagcattctcagagctagaagaaccgttgctctgagcagattgagaagaactagaagaacttttattattatcagtatcgttggctttcccaatcatgagacgaataatgtaatcttccttgtaagttaagggctgagtaaattcgacgtgaatattcgttgcgattggtgctgaaatttccgcttctgtcagtgtaaggcgaataacggattgatagtaaccgtcaactaacttgttactgattactttagtagcatgttttgtatcgctgaaagtgattggtgattgccccatcatagccggtgtatgagttgtgatgtatgcgtaataagaaccgtcagcattctgggctagcttaacagttggcagcatgtaagtggcggccattgatttctcattgctatccttttgaaggatgtttaactcacgagtagattccgagatgggcggaatcagcttggaatcgggcttactgtcattaatcttgactgccttatccaggctaagcgctaagtctgtttgcgcaggcatgcgaacggcatcattaataactagcgttactttagtattaagcgccttgcttaattcccttacaggtaatgacactgaccaatgggtgccggactttgtagccgccacaccattgatggtaaagtcagacaatttcatagctggtgtgcttacttcttctgtatcgatggttgcacgaccatttttcacggtcacagtagcagtcggcttataatattgcgccaccattgatgcctgattcgtcccaggcttgtagtgattaattggcatttgataaacaccatccggtagtggactgacagaatcgctttttccagaaccgttatccgttacagatgtcttttcggctgatgaccaaacaaaatataaatcagaacggaatggcttcataaattttgcatatgttgggtccaatccagcgggtaagtaatccacaagtgtattaatgacaccgttcaattgtttagtgggcatcgtgattgtatatgagtatgtttgctcatcaaacttggcctcgatgagttcaggaccaacttgatagtgccggaaagttgccagtttctttttgctaggatctaactggaacttaattgtcgctgttccatcggtgttaattgttacttgttgtcgtgacttaaagtattgcgcgataacagattcagtgccgaagcctgttcgaccaggaattggtttatcgcccggtgtgtaatgcgttctgtgattatagttgtacacagtgacgtcatatattccaggttttaaattggaagcatcaaccgaatttgaaactggttggtaaatttctgaagcgtgaacgttagcgctgccgtccagtgatgttgtcgtcaacacaattccgcccagaataattgttgaaaataacattaccgttcgtgataaatgatgcatgataaatacgtttctcctaaccttaaaatacacttccacgtgttcttttgtacgatcattcgaataaagcggacgccgtaacataagtcattctatgcagaaatttcaaggcgaaacaaggaaggctccaaggtttaggagtgtttttttatcagtagactatttttttaaagcacaccgaaaagcacatgataattagcaacagctagcgccagtttctagttatctagccgtgatttacatgctattggtgtttgaaaatgttaagtgcaagcgaagcaccaacaaagccgactgacgccgtaatcacaacgccagctgtaatcattgttgcgcgtgttattttagagtgcttaggtgcgtctgattggctagactttgatgtagacttgtcatttttatttttagaaacagtttgcttcttagccggtgttaatttgattgtcttatcagatgtcgctaattctgaggtgctacccgtttgtggtgacgaaattggatgagtcactgccaatggtgttggtgccatcggtacggatgatgcaacagtagtgaacgtaactggtgcgggctcaaacggtgttgctgtagttgctgtttcacgtggaacaattaccgtatctgtcagctcattttgattgttaactgatgcgttgctagacaattgatcaccgataaccagacgaatctcatagttttcgtcataaacaagtggtgatgtaaattgcacgtgaatgtgagttgaaattggtgtcgtaagttcagattcacttagtgttagacggaaaacagattgatagtaaccgttcactagattagtgctcattaactcagcggcgtgttttgcatcgttaaaacgaattggattttggcccatcattgctggtgtgtgcgttgttagataagcgtagtacgtgccatcagcatttttggttagtttgacggtgtctagcatatagttagctgccattgacttatcatttttatcggcttgcaaaatgcttaagctacgggttgaatctgtttctacatcagtaacatccgtagaaggtttcgcgggttttgttgctggttgagatgggaccggcttgtctgatgttgtagaatcaggaacctcgggaactgttgatggattgttagtgagggttgcgttcttaatatcaaacagcatatcagtcgttgggctttcgatgacgcgtccgttcattgaaatggtcatgctagttgcgatcgttttacttaatgcattgaccggtaaagtaaccaaccagtgcgtgcccttagcggttgctttaacatcattgaaacggtaattagacatcatgcccataatcatttcgttactagtttcaatatcgatattagcttgtccattattaacagtaattgtggccggcgtcttcaaggatctattcatacttgaagcagtcgtcgtaccagttttgtaattagtaaatggcaccttgtaaacaccatcttgcaatacattagcgtccgctgtcgtacttgaatctgaaatcgccccattattatcactaacagatgtatcagtattttgattatcggttggtgtttcatcagataattgtttcccaacaactagacgaatatcgtatctgtggtcatagacaagtggagaggtaaaatccacatggatgttggtagtaatgggtgccttaatttcagattcagtcaatgttaagcggaacaccgattgatagtagttatccactaaattggtactcaataacttagctgcatgatttgtgtccgtaaagtcaattggagttttccccataattgctggtgtgtgagtcgttagataagcgtagtaagtaccatcttcatttttgcttattttaaccgtatccagcatataactagctgccattgacacttcatcattgtcagcttgcaaaatgcgcaatgcgtgtgttgactcttcaccggtagtcccccgctcgtcaacagatgtactttgaacgggttgtgccagtgagttggtcatatcaaatgacaaatttgatgcagtgatttcggcagcatatgcgacagttgcagtgctggtaactgatgtcgttaacagcgctacccctaagacagctgttgaaaacaaaacggcagtacgtgataaattactcatacttaatattgttctcctaaaaaataaaataaaaccctgaaataatagcgattgtgaaaattcacagaaagttcacaatttaacttttaccattctatgcagattataagaattaatgcaagctcaattccgaagtttaggaattgcatatgtaagtgttaaaatgaaaacaacaaatatatttggggaatggttattaggtatgaaacaaacatttgcggtcattgggttagggagatttggtggttcgttacttgaatctctaattgcggctgatcaagaagtactagcgattgataacaatccaacgttggttgaaaactacatggatgtcgcaacccacgctgtgattgctgatgcccaagacgaagatgcgttgcgtgatttggacttacctagttttgatcacgtgattgttgcgattggacacaatcaacaggcctcaattttaaccacgattttgttgaaggacatgggtgttcgtcacgttgttgcgaaagccgaaaacaatttgcacgcgcgtgtgctagataaggttggtgccgaccaagttgttcgtcctgaacacgaaatggcgcaacgtttggctgaacaaatcatgacacctaacttgattaactatattgatttgggtgacaagcattcattgggtgaaattaagattgccaatttgaagtttgcgaataagacaatttcggaattgaacattcgtaagaattacggattgaatgttattgcgattaagtcgcaaggacgagttgttgtagcgccggaatcttcagagatgattcaaattggcgatgtgcttaccgttgtcggtgagagtgttgatgtaaagcactttgaatcactcgttgaaaaggtgaaataagccggaaagcttgactaataaataagaagttattatagttaacattattaattgatgtcttgatgaagaaagaggttctcagctgaagttaacaacttaagagagctcgcggttggtgaaagcgagtgtgttaacgttggggatggcgcttttggagagattttcaattgaccgtaattaagttgctcagtcataattgattgagaattagggtggaaccgcgttaatgaacgtccctatgtcaaatttaatttggcatggggacttttttttataccccatgcagtgagggtttattatggaaaatcaaaatgagcaacgtgaattgtcacgtggtttgaagtcccggcacattcagatgatcgccattggtggtgccatcggaacgggattgttcttgggatctggaacggcaattaaagccgccggtccatcgcttatcctggcgtacattatcacgggtatctttgcttacttgatgatgcgagcggttggtgagttgctgctatcaaatactaagatgcgttcattcatcgatttcgtccgtgaatatcttggtgataaatgggaatttgccatcggctgggcctattggttgagttgggcaagtttggccatggctgacttaacagcaaccggaatttatcttcgttactggttccccttcctaccgcaatggctaaccccattgattgtggttgtggtcttggtagcattgaatttggtgaatgttcgctggttcggtgaattggaatcagggtttgcatcgattaaggttattgcgattatcgcgttgattgtcgcagggcttggcttgattgcaactgggttccacactggtggtcacacggcaagctttgcaaacttggttgatcacggtggtttctttgccacaggtttctcaggattcttgatggcattcccaatggtaatcttcgcctttacgggaattgaaatggttggtttgactgctggtgaaacggaaaacccagagcgtgatttgccaaaggcaatcaacgccgttccagttcgtgttggtctgttctacgttggtgcggttgcaattatcatggcaatctatccttggaatgacatcaacacatcacaatcacctttcgtgcaagtgttcgctggtatgggaattaagtttgctgctgatttagttaacttcgttgtgctaacatcagcattgtcagctgctaactcagctatcttctcaacatcacgtacgttgtatgtgttggcaaagaacaagcaagcaccacactcattggccaagatttctaagaacatggtgccagtaactggtatgttggcatcatcaatcatcttcttggcagttgtgttgttgaactacttcttcccatcacaaatcttcgttttgattactggtgtggcaacaattagctttatcttcgtttggattttgattatgttggctcacatcaagtacaagaagacgactgcatcagaaactaatccatacaagatgccattgtacccggcaacgagctatttgacgattgccttcttcttggcagttttggttatcttggttttggatcctgcaacgcaagtctcagttatcgctacaatcatcttctttattttgatgattgctgggtatacactttggtcaaagcgtaagcaacaaacattgtaaaaataaaaattggcagttcgcgtttgcgagctgccaatttttttgcttatttacgatcaccaacggtaatcatttgattgtgccacttatcttgtagcaaggcttccaagtagacaagagcaactgtttcacgtgaaacagtttgcgcaggcgtcttttcgtgactgtctgtgataattgcctttccagccgcgcctccatggaacataacaggactgataaccgtagtatcgaatggtgaattcatcaacatctcaccggcttggcgttgctggctgaagtagccaggcatcgccttccaaagttcaccttcacgaccagttgtttcttggttcataccaccggcacccagccacaaaatacgttgaacatctgtaccagattagtcaatcgcatccaatagggcttgcgcgtacgttggcattggtgatgatccgacgaagctgatgataatatcggcatcacggacagcgtcgaccaagctttctgattcatacatgtcaccaggaaagacttggtagctgttttgttggccacgcgttagaccgcgtggacgacgcgctaacaatgtcaattgcatatcgtttggcgcgacgttttcaaaattatcgataaaatactgtgcaacatttcccgttgcaccaagtactagtacatttgtcattgttaccacctcattttcttgtgcaaataatagcacagaaaattaaaatagtggttgcaaaagggctagtccagaatgagttggtaagccatgcgctcaccgtgaggaactggcatttcaaccatgccacgataatcgaagccaaggttagtcataactttttgcataatgacattcttagggtatgtgtccatgcgaatatcattaaagccttgctccaaagaaataaccagcaaatcttgtaggaattgttgcgcaagtcccttgccacgaatggtgccgtccatccccacacggtgaatcgtcatatattgcgtagcatctcctgcccatgaaccatcgatttcttcatagggtccttctggtccaggaatcaacttggcgatgccggacaccttgccttcgtaaacttgcacgtaagcaatgccttcagtaatagccgtttcaaattcttcacgagaaggaccatccccatgttgccattgtggtgaatcttgctcggccaaaaaggcaatcgcatggtcaataattgtgctaatggcgtctaaatctgacaaacgcgcacgacgggtataagtcgtcataagtgttctcctcagaataaaaggtttgtttcttacataataggctattctagccgaaatatgatgtcgatttgttatcaagatgacaacagattagccagtcagcttgttgtcgctgtggggctcagttagaattgatactatcaaatgaaattcatgaggtttcgacatgcaaaaacaaccaggagattggatcttccgtgctgttaaaggtgcactgattggatctgggtttatcctacccggtattagtggtggcgcattagctgctgtatttggattatatgagcgaattatcaacttcttggcgcacccatttaagcgcctgaaggaaaatattttctttttcttgccagttggtatcggcgcaattttaggtatttttgcgctatcttttgcgattagttttgtgcttggtaagcacgaaagcgttgccctttggttcttcgtaggtgcaatcatcgggacgttgccatctttgtggcgtgacgctgccaaggaaggacgtaccaaagtcgatgtagtaattatgattgtggcatttgctgcgatgttggcatttttgctgtttggtgccccactcttttcagaaattgagccaagttttggtgcttggattttagcgggtgccttaattggtctgggcttaatcgtgccggggctgagcccatccaatttcttgatttacttagggttatataaaggcatgagtgacggtattaagcatggtgacttaagtgttttggtaccaattgtcattggattgtttgccatcattgcactactatcaaagttcatggcttacattttcaaggttgcgtatgctaaattattccacggtatttttggaattgttttagcgtcaacaatcatgattgtgccgaatgattttaacgactttacgattattcacgttgtcatttcagcgttattgctagcacttggaacgtggcttggttggtggatgagtcgtttggaagataagatgaatacgaaatagagataaagcggtcgcacgataatgtgcgaccgcttttttcaaaaaaaggttaaggaattcaagcaccaagttgtcacaaaggtaacccggtgagtaacgatgctacaatcacgtcacttaatactgatagtgaatgaggtaaacattatgaatgtgaccatgcatttaaatttagaggcatttgaatttgagctggcagatagtcaggtgattgatgagttagtgagtaaaaagaagttgaaagtcacgatgttagaccattatgggcgattggacgaaggcgatttggcagaagctttttcatcagatgatttgacgacacgtgatttggtgccgggtaacctatactatgaaactgaaggtaagcgacttatattaccctatgaattgctgaagaaaatggataaacactatgttcatttggctgcagcagtcgatgcagaagcgtttgtcgcttttttgaagcaggcagatcaggaaataatactaagctgtaaattataaaagcaggcggacattaaaatccgcctgctttttaaatagcgcgcaaaatagccatgctgataataccgactaaaaccgtccacataattgatttcgttcgccaaattgtaagcaatgttggaatagttgcgaaaacggctaaccaattaatgccaggtagttgtcccgctttaatcacgactagatcttcaaaaaataacgctgtcattaggcttagtggaatgaatgctaaaaaagattgtagccaatttggtaagttaccaaaacgaactaaaacaaatggtgagatacgaggcaaccaggtaactaatccggcagtaattaacacaatgacgtaataacttgtcatacaaaacctcctgggcgtttagcattcaaatatgcacttagtccagcagcaataacagtcgcaatcagtactgcactagcactgccgaaaaatggtgccatgattagataaatcaaaaccgtactaccgacagtcgtgatgattaaacgacgagttgtgatgactttggcagtatcgatttgaaaataccaaagcgccgcaaacatagcgactagagcaaaatccaaaccaaattgctgtgggtttggaataaattgaccaaaaaaggcaccaacgaatgtcgcaataatccacgcaagatatgacgagacatttacaccgtgctgccagctaaccgtgatgttggtgttggtatgattactagcaaacacaccgtaggattcgtcagttaacagggatcccatgccgatggctgatggcaatgattgatggctaaatttttgagccaccgatagcgacatcaataagtgccgtgcgttaactagaaatactaatgaagtaatcgcagatactggtgccatggaagcagccaaactggtcattaaaaattgtgcgctaccagcataaacaaaaattgacatgccaacaatgaaccaaattggcaaatgcgcactgacgcccagaatcccaaccgttaacccgatgctcaagtaccctaacatggttggtgcagcatctaatacaccacgtttgaacgtgtacgtttcatccataagcctgccctactttccagattgtaaagatatgtgcaattacaacatacatactcggaaatcactagcgataaatttgtcacagctattaaaaaacagatttaataaagtgctcgtttaaggttgaaaaagtttcatccaaaatttctttaaggctttcaaactacgattaaatcattgaatagcagaaatcatcttttgaaccaaatggaggaacgcgttatgtttagctatagtacattggattatgcaaagtttgtttacgacccagccatttgtgattttattgcgacaaccaatgatggccaaaatgtggatttgcgccaagttgcatcagcggaagaaacagtggcatatcaattgccggcacctgtatatcaacaagtatcaatgtagttaacaaggaatatctaaaaaaatagacgaatcgcaattgcgattcgtctatttttgtggtctaagcgcgtgaaagttcgtttaaagttctgccctgagcatcttttagctgaagccaagtgtttgtaccggcaaagtacaggaaatggccgacttcattagcactcttcaagaccacatccttagtagtgtgaccattagaaatggcgtcagcgtgttcttcacgtaatgttaaagcgaatcgctgtgcaaagccgactgatccatctttgttcagtggcatatcagtttgcaatgttgcgcccgcagcgatgaccatttcatcacgcttgcgccaagtaacggttgcctttgcaccgttgtaatcaatgaagaatggcacatctgcaaagtcttgcttaaaacggtgttgcgcttttgctggtttcttaggagctttagtgttttcgactaaggaatcaagttacttggcaattccagtagataagtcagttgtaccaaacaattctggcaaagcgttggctgtttcttcggatagcgtaatcgtgattttctcgggcatgatcagatcctctaaatttacttgtggtatgggctgtgagcgttaatcataaacgcacggtaaatttgctcagttaaaaccagacgcatcaattggtgtggcaacgtaaatcggccaaaactaatttgtgtattggcgcgttgcaaaacttcaggcgccaaaccgagtgatccaccgatgacgaaagtgatatccgaatcaccgcgaagagccaacttatcgatttcggcagcaagttcttcactgctacgttcgtttcccttgatggccaaggcgaaaacatattccttatccttgatttttgatagaatgcgttcgccttctttgcccataacttggtccatttgggcctgtgacaattgttcgggtgctttttcgtcaggaacctcgattatttcgaactttgcaaacttttgcaaacgttttgcgtattctgcaataccatctttcaggtatttttctttcaattttccgacaccaatgattttaatattcattcgtcttaaacctttcttaagaaatttattgatttcatcatagtttttaacagttgtggataactgtttaaacaaattgcaattaataccttttccacatgttactaacaggttgtgaattggctacaaacgttattatatcaaagattcatagggtttacgtggatagttatccacatttatccacagatgggtaaaaatcgtgtggataactctggaaacgttagaaactcggcatttgatcataatttttcacaatttaagccacaaaaaattctggagtaaaaacagttttgcacaccccatttttgcctgaaataattgaatacaaagtatgaaaaggatgtaagtttgtaatattcggaaaacaggatgatttagcatcatatacatgaaaatcgtgatatttgtcgataaaaggcgtacattttggcatgtgaattcagagagctgccaaaatctctaaaattcattaaggttaaacttaacaacgcttcagaaatgcccatatttaggggtattgcatgtaacaattagtttcgcacaggttttccacactgacttttcccccgtggatagtgggtttcattgcacaaatggccattttatccacaagttttccacaggttgtggggaaaagcatgcggttatcccctatttatccacaaaattctgtgtaaaaccttcatcgcgcttcctgtataataaatcaagttgggggatacttaatattatgaaaaaacgattcagtggtttaacaccgccacaagtcttaacgttaggttttttggcaattatctttgtcggcgccttgattttgacattaccaatttcacatcaacaaggtgttcatattagttttatggatgcgttattcacagccgtgtcggcaaccgcaattacgggtttgaccgttgtgaatactgcgaccacctggtcactattcggccagattattctattgattatgattgaaatcggtgcccttggatttatgacgtttgcggttttgttatttgcaatcactgggcaacgaatggatttgaaagcgcgtttgatggcacaacaggctttgaatctgcgtaatttagcggatgttaagagtgtgctgcagtacgtcttctcgctatctgccatcatccaagtcattggcgctgttttgatgatgccggactttattccccgcttcggctggacgcacggtatttatttgagcattgcatcatcaatttcggcattcggtaatgctggatttacatttttcgatgaaccagtattcttcttgcgcaatgatccatacattttattggtctggatgctgttaatttcagccggttcacttggattcttggtttggcgtgatttgctcttattccacaagcaacgccgattgagtttgcacacccgcgtggcgttgtacgtctcagcgtggttaaccggattaggattcttattcttcttgtttaccgaaaaaggcttggcgccgttggctaattcgacttcaattggtcaccgcgtgatggatacgctgttcttagcggttgttcctcgaacagctggacttgaagttgtgccacttagttcgatttcggcggctggtttaatgattatcatgctgttgatgttcgtcggtggaacgccaggatcaacgtctggtggtattaaaacgactacgcttggtattttatggttgcagtcaatggcagccctcagaggtcaggaaacggttaatttcggtggtcgtcgttttagccaaaaaattgtgattaaggcgacgatgttggctgttatatctagcgtattcgtggtcggcgtgtcattgttgctaaccatcacggaatcaattcctaagggtgaaggtcttgaatacattgtcttcgaagtcatttcagccttttcaacaactggtttttcaatgggtctaacccctcacctgactgattttggtaaggtggtcattatgattgtgatgttcattggccgtgttggtttgtacacggttatgttctcggtcatgaatattcgtgaaaagccaacgagcttccaatacccaactgaagaaattatcattggttagaaattaagcaccgacaatattttgtcggtgctttttatgtgcattctggatacaatagtcttaaacataggaattgaaacgggggaaatcatgacgaaggttgatttggtagcaacggacttggatgggacgtttttgagtgatacaaaaaggattaacgaggacttttttgaccaaattttaaagcgacttgaagcgacaaatggtcattttgtgattgcgagtggtcgtgatgaagagcaaatccacaagcaatttaagccatttgttggtcgatatgatgttgtggctgataatggtgcagttgttcgaacggctaaaggcgaattgctaaatgtgtctgggttgtctgtagcggaagttgaaacaatgatgcaagttgtggctgatttaccatttgatccacgtcaaggcgcgctatttactggtcatgaggcggtgtatatgttgcgcgatcaaggtcgtttgaacttggctcatcaatcgctagttttgatgatgttttcaaatgttaagatgattgattcattagatgagattcacgaaccaattttgaaggtgacaattacgtatgctgagcatcaaatgatggatttcatcgctgcagcgcgtgacgcgctgggtaatcgcgcccacgtgaccacgtcgggttacggatcagtcgatattgtggcaccagatgttaataaggctaatgggttggcgtatgttgctaagcattatggtcttaatttggagcaagatttggttgcgtttggtgacgggttgaatgatgctgaaatgttggcaaaagcgaagcgtccatttgccatgccaaatggtgataaaaccttaattgcaacctaccctgttgcggatgctgataataaccacgacggagttttaacaactttggaaaatttattaaataaataataagacgacaatacgtttcaacatgcaaaattatgcatattgaaacgtatttttatacaggaatcatcccttggcttgatgttcaaaaagcgactttgtgaagttcacaaactagtaacattgttgatttaaaatttaaagatgaagttaaatgtttgttcgcatcggagttcaaggaggaataaccatggcatatatggtatttaaagttggcgcacaacgggtatcatgcactgtatatgatggtgaacaaccaaaagaacgatctggattcgatgttttaggggctgatgaacagattgttgccaagatgaaacgcttgattaagctctatggcgctttttatacgttgaaaagtgttggtgtactaaccgaaaatggtgattttaaagaaaaaacgctgcaaaagttgccggtaacggtaggtaaattatcggctgaagacacggtcaaaaacacctgccaaatgtatgatacaaacaactaatcgttatttgtgaatgatgtcacaaaaaaggtttagattttataaagacggtagtgaatgttttcacaaaacagtcatagcaagggtttagagcaacataaaataaaaaatcaccgtcaataatgacgatgatttagcaattatttgagattatccattgcttcattaagcaatttgtctaccagaatgttacctgcgctggttgcgtgtccctttacccagatgaatgacaaacgcccctttacttgttgcaccaaatcatagacttgttgccaagcagttaagttagcaatttcgccagaagctttacgccacccctttgattgccagttgtacatccaatctgtgacagtgtctagaacgtactttgaatcgctgacaatcgtgactggttcaggaactttggccatctgcaaaagcgcgttgattagaccgagaatttccatttcgttgttcgtgcgaccgtaaaaagcaccactgtctgagaaaacgggtgtctgcatatctgagccacggtaaatagcgatcgcccaagcagctttgtcagttggacgcacgtgaccaccagctacattgcctgtgttacgactaccaccatccgtgaagatgtaataatattcatcttttgcatcaaatttaccatcgtaagctgtttcgtatttacgtgataaatcacctgaggcgccagtttgatcatcaaaccaagcttgtgcttcaacgcgcgttgcaaagcctttgtacttcggtgctggctttgtgtgggtgtacttttgaacctcagaccatggcttggtgtagaggccctcgaactggtttccgacaattgcgtaggtcttcattgtttctccctaattttcgattaatcttatgtaatatcatagcttaaattgttatgtaacggaattattcagctattttttattcgaaggggaaccgaatgtttaagtattatttcacttatgaaccatcgattccaacgggcattgggtttggccaattttcattgacccatggcacaatgcttttgctaatggcgggtttgatttattatattgtccgctattatactgcagcaactgacaatcgtcgtcgccacatgcgttgggggattgcgattgccatttggacgatggaattatttaaggatttctatttggctgtgactggtcaatgggaaccaagtttgttgccactgcatttgtgtggctttgggttgatgatgattgcggtggatgccatccatcctaacaaaaccacccgggaaattttgtatagtttaacgatttggggagctttcgccgctgaaattttcccagattgggcgtactatccaattatgaatcaatgggcattacaaagtttcttgatccacgcattgttgattgcctatccaatgatgttgatggtgagtggcgaaatggtgccaaactggcgtgaattgtggcgtccggtattattcttggttgttgtcgtaccgtttgtcatttgggtgaatggtcaattgggaacgaactttttcttcctaaacgttgcagcgccagggtcgccgttggagcctttgcaacaagcttttggacatggtggtttgtatatcactgtggtgctctcacttttggcgttgctgtgggtcatcatgtacacgccatgggaaattgccaagcgtcgtaaggcagcggtggctgtcacagtataatctgatatgaaaaaaacggtagaacgctgagttctgccgttttggtgtttacaatggaatttttaaatcatgatcagggtttacgagcttcgttttcttaacgaaaatcatgttcatcaaccaagctgagataaccggggcgatgatatacgcaccaagcagtctcaaccaaatataggcgccgtcagatgcttgtaaagcggttagagggccaatgaggccagatgcgccaaaaccagctgaaaacggcgttcctttgattgataagagagttgcgacaccgccagtaataccggcagcaatcatgaccggaacgaataacaagggtttacgcaacatattggccatttgaatttttggcgagccaataacgtgggcaattgtgccaccgattggattcactgaagcgctcatccaggctaatgtcagcgcaccagccacgattccagcgtttgccgctccagatcccacgctagcgatgccaagggccgttgcgataccaactgatgaaatgggggaaacaatcaaggctgcaaacgctaggcctaagaatatgcccattggtaaaggtgaaaggtgggttgccaccgcaacgacattaccaattgcattttggatgcgaatcatccaaggcaaagtcgccaaaccaatgccaccgccaatcaacaatgtgatagtgggcaagaaaataatttttagttgaccgagccgaggttccaacataatcacgagcaaagctgaaaggaacgtgacaagcataatgttcaaaatcgcgccggtaccggctagggtataggtgttgttcggattaatcgtcactacaccggctgagacaacgctcgctagaccgattgaggcggacgctaacgtactgagccgtaggaaataaccgacggcaaacgcagcaataatcggcaacatgctttgtgagacactcgtcatcatggtgatgagacgaacccaaggatgttgaccgaaaagtaataagacctggcttgttaaagcaggtggcaacagagcaatgataatgccgaggctattaccatttaagacatttaacgtgaaatcttgccaattacggcgcggtgatacaagcgtttcagggtgcatcgttagcgtctcctctttaatgggtatgggtgcggaaaataaaaagccgatttgaatgaacaaatcggctttgatttgttgatactaatcatacggacaaaccaattagtgtcaactagttatttaactttaatttatggtctaggtggctaaaaacagttttatcggcataaccgatcacgaccccttggaaaaagaatgagaccaaggttccgatgttaactgctaccaagttgccagtaaaggcccaaacagccaatgagatgaccatcggaatggcgaaattaacaatttgcgcgacaccggcgtttcccttgaagaacatgaaacgcgttaagttcgttaagtcatctaggggatgcaaaatgaattgcaaacgctgggtgattgaaaccccgcaaccgactgaaacaattgcaatcaaatcaatcaataagcgggtgggcattggcaaatcaccgatgccttgtgcggcaaaaaatgatgagacaaacccaatgatgacactaaacgtcaagacgaatagcaaattaccaatcacacgtggccaatcaatactcttcaaaaggacgcaactgagaatcgcggcgataagtccgtatgcaaacaaaaacacactgattgataggccggttgcgttggccaaattggctgcagatgccgtccagggtgctgaccccatgttggtggcaactgttaagccgttaccgacagcgttgaagagcaagccggcaataaaataaagtcctgtttcacgactgcttaaattgcgcagctgtccgttttcgttatacatcgtaaatacctctttctctattctaacagtatgtgttaatgaacaaaacgactgtcaggactttttaagaggttaattaacgagtttatgttacgataatgttacaaatggagaaattattatatagggggacttaattatgggtgcttatggagctttttggcgtaactattttaacttttcaggacgttcaacgcgatcagagttttggtggccgtacattattaacattgtgattgcgttgattttgggatttttggcaggaccacaaagtagtcactggtggacagcgccattcggaattgcgacggttgtgtttggtttgttgattatcattccgatgtgggcattgattgttcgtcgcgtgcgcgacacaggtgttaagcatgtggtcctttggggcgtattgggagtcattttcaacatcattgcgttcatttttggtttcattccaacaaatcaatttaagtaacgggaatgttcggaaaaatagagataatgttcgtgtttagaggtcgttttcgacctctttttatttattgtttgcaaaacctttgtgttaatcgttttaatgtgcgacaatagttaagttgtttttagaaaagtgaatacattttataaggagttttgcttcatgtttgaacgctacttcaagttgtctgaacttgggacgacgatgcgcacggaatttttggccggtgcgacaacgttcgtttcaatggcctacattcttttcgttaacccatctgttttgggtgctgcggggatggataaaggggctgtgttcacggcaactggattaatcgcagcgattgcaaccatctttatgggtgccgttgcacgttatcctttcgccattgcaccgggacttggtgtgaacgccttctttgcttacagtgtggtaatcggaatgggcgttaaatggcaaacggcattggcaggcgtattcgtcgccggtgtcatcttctggattttgacagttctccgcattcgcgaaacgattatcaacgccattccagctgatttgaaggctgctattgcaggtggtatcggtttgtttattgccatgattggactggtcgacggtgggattgtcgcggccaacaagtcaacgatcattggctggggcgactggagcaatccacaagtgatgctaacgatttttggtgtcttggtcagttttgcgttgttcgcacgtaagattccaggtgctatctttatcggtatcgtgattacatcaattgttggattggtaacaggcttgattcctgcaccatctggcattgttgccggggtgccgagtttggcaccaacgtttggacaagccatcttcggtttgcacgacgtgttcacaatgcagatgattccagttattctaacgttcttgctagtggcattctttgacacggctggttctttggttggaattgctcgctctggtggattcttggtcaacaatgaattgccacgtgctggtaaggctttgatggccgactcaatcggaatgttgggtggtgccttgttgggaacatcacctacaacagcattcgttgaatcatcaactggaatcgccgttggtggtcgttcaggaatgacgtcagtctttacaggaatcttcttcttgttggcattgttcttctcaccattgttggttgtcgtgacgtctcacgtgacggcgccagctttgatcgtagtgggtgtgttgatggctggaaatcttgctgctgttaactgggaagatttcccaattgccgctgcgtcattcttgacggttattggtatgccattggcttactcaatatcagatggaattgccatcggatttatcgtgtacccattcttgatgatcgtaactggtcgtggtaagaaggttcacccaattatgtatgcactagcagttgtctttattggctttgtttacgtgctacaaactaatcattaataatgagttgtttcatgtgaaacaaaaatgggcagggctaccaatttggtaaccctgcccatttattttagtgagatgctacgaatgccttaaagtttggcatgaccgtatccaaccaggcgattgtgctgtcatcagtgagattatccgtgccacttaacttttggtgaccggcaccaactagcgtatcattccccatcaaaacgggtgattgtagggcaaacaaaatatcgcgcaagtgcatttgcgcataaacggttcccaaaaatccaggggtggttcccatgattaatgatggcttgttgatcatgaccttgtcgacacgtgacaaccagtcgatggcgttctttaggacacctggaattgagtggttgtactcaggcgtcaaccagatgacaccgtcagcctctttaacagcttgcttgaatgccacaacttctggtgaaggtgttagttcatcatccacgctgtaaaatggcaagttattaatagatagaacatcaattgataggtcatcagaaccgtaacgcttggccaaaaagttagccaagacacggtttaatgagttcttgctgttactaccaacgattgcaacgtatttcataaagcttattctcctacgttaaattgaaaaatactgtcttcaagtttacagcaggaatgatgaaaaccaaaatgatagccattatttggcagatgtttgttgatacggaaacaaaactcacctataatgaaaatggtataggagggttttgttatggaccaacaacgcgttttcattcagagttatatgtcattaatgagcaagttagtcggactgaatcaatcgaagatgagcgaaaaacttgctgattatcgtcacccagaagtggagacactagagttcattgcgaatcatccagacgatgcaaacgtcacaaaattggcggaatattctgatatgacgcgtggcgcaattacgaaaatcacgaataagatgattgaaaaagggctagttactgattataagaagccggaaaacaaaaaagaacgatactttacgctgactgacaagggacgcgaagtgaatgaagttcatgagtcgttgaacaacgaatttttcgatcgggacaagccggtgttcgatgcagtgagctcagcagacattgataagatgattgcgtttgcccaaacttacagccaatttctggatgctgaaatagcgaaaacaaaagaatagataccgaagctgcaactggttttaaacgagttgcagttttttattgttcttaattttgttgacaaggaaacaaaataagtttaatatctatttttgttgacaaggaaacaaaaagaagagtcgaataaatcgacgattcttgctcacaacaattaaacgaggttttatatatatgttccattcaaagacgatgcaagtcgatccgctacctgctaatttggttagcattgcgtggttgttagtccttggtgcgatggcgcctatgttggattcaacgatggtgaatattgctgttaatcaactgcgcattgattttggtaccagcctggcactgattcagtggactgttactggctttattctagcgatgggtgctgccgtgccattttcaagttggctagttgatcgcttttccggcaagatggtctatttctggtcagaaatcgcatttggtgttgcgtcactgcttgctggcctatcaggcaatgttgaaatgctgattgcattgcgcattgtgcaaggctttgcggctggtatgattatgccggttatgttcacgctgctagttgatttatttggcggtgacaaaatgggtcgcgtgatgtcgattatcggtgtacctatgacattaggtccgatggctggaccgattattggtggcttgattgtccaattgatctcatggcgctggattttcttcattaatgtgccaattgttttaatctcagcattgatgttatataagaaggtgccagcgattgcgcctaaaaatccgtctgctacttttgatggctttggtgtcggcttgttggtcgcactttcagtaacgtttgtttatggcacagtgcaagccagcacgacaggatcgtttaacaaccagctaactgttggcttcggtgcgttgacaatcgttattttaattgggtacttgttgcacgcttggcgttatccaaacacggcagtgttgccccttcgtcttttcaagcaccgcaatttttcaggtgccatgctaggtaacctcctagccggctttatcactagcggaccaatgattttgttgcccctctttttccaagatgttcgtggcgaaagcgtcattatggctgcggtatcactcatcccacagagtgttggtatgctagtttcacgtggaacaattggtaagttaatcgatacgattggtgctcgttgggttgtcattacgggtacagtacttactattattagtacattgccttttgtattctttgatgcccagacggcctactggttaattgctattgtgatgtttgttcgcggtgttggtggtgcggcggttaagtcagccatccaagcggatgcttatgttggtatcgaccgtgctgattcaggtaaggcatcgttgggatctaacttgtttcaacaagttggctcagccttcgggtcagctgtcctagccacattggttgctggctttgtcagtgcacatcacattgttcaaacagcccaattgttgggtgcatatcaatacgcatttgcttgggggacagtctttgttggtttgatgattgttccggcatttatgctaactcacaaagtgaagtaaatataatccacaaaactgttcacgttcgcgtggacagtttttaatttaggaggattacatgacattgaatgtcagaggttgtatatttagttaataacgaattttttagggtgagaaaaatatggagtggatgattgagaaaaaggaccgccagaaagtagagttactacgctatttggtatcgcggcctgagattaaattgccactaaaggtagtccaagaatacttcgattggtcaaagtatatggtgctatcgacaattcgtggcttgtttgatgatatgcaggaattttatggtgaggaaccatcattttttaaattatcagaagatgaaaaaatgattgaattaacgcagaatcgtaacgttgattcaaacgtctttgcgttgcagtacatgcgtcaatcaattccgtggcagctaatgcgcgagacgtttaatgaaacgatgcgttcatatgaagagtttgctgttcgcaatttaacaaccgtttcttcagcgcgtaatgggaaactacaactcaacgaattctttgaacaacacggtattacaattacgcagggttatacgttgacagggagcgaggcagaaatacgcgcagtgtatttccgactattcgtaaagtattttgcagatcgcatttttcctttttcggatgaagagttggcgctagcaaatcaagcgattaaagcgattatcaaaattatttcacctgaagaaactaacattcggcaaagtaagcgaattgcgttgcgattttcaactgcgatttggcttgaacgtctacaattaggtcattttgtggaagatgatgcaattgatgatttgttgttgccaaatgatcaattaaacgacaagtcacagcgcctcattgcgtatttcgaacagcaagtgaagctgcgtgttccagatatttctgatgagcacctacatcgtgaagcacgttatgccttgattgcgctattttcaattgacgttgggtatgaagttggtcgctatgagaatttgacaccatcagcggcggggatgattgagggatttattcgcttggttgaccatcattatgatgatttctttggttatcagttgacggcacgtgaacgggaccttattcgagaagtatttttcggcacgttgattggtgcggtggttagtccgacaagcgacgatcgacaaatggtggtgcgcttcgatgcggcgtatgaacaattcccattaatggctgattttacgttgaatctgattgatgatattgcagagcgtcgtcaacttgatgtgacggcagcacgaaatgcgtattttgaaattctttacgttggatttgcatcggtatttgatatgcaccgtgtgttcccaaagattaaagttgcgatagatattaattatcaatttggtctcgaagctattttgacagatatgctactaggattgcgggcaatgaatgttgaggtgtctgaattcattgatgacgacactgatattttgatatctgacatcaatcatgcacagattcccgaagaaaatacatttatctggccaacgatgccaacctcattggattttgagcaattgcgtcgccgtttgagcgaaatgaaggttgaaaagtttgaagaagagcgtggaatcaagctacgtttccctacaaattaatacgttttttttattgttaaaaaaaacaaaaaaattacaagcaaacctcacgagaagtctttattataaataacgtaatagaaatgatgtgcaagagaaaagggaagctatattatctttgccagtcgttcgagcgtgctcttctgcgggagacaaacttgtaaccgaacaattgaagtcgctgactttttggggtttgttcaaattcaagtgaatgacaatggtgcctatctgcgaaggcgatagttgtgtgaccacaagtgaatcttcacagatgatttgttacgggaaatattttgatatatttctactcactcaatactctctctaaaaaataaaaaccaggatgtctgcgcatcctggtttttatttttaacggctgagattatttagcacgtccaacacgggttggaatgcttcgagtgtgtggtaccggtcaccaattagcacaccgtcataaccgatggcgctggcgattggtgatccaacttcatccatgtgcccgcccagaatcaattggtaatcaatggctgggtaattgcttttcatgaaggcgcgaattgtgttgtgcacatcgcgaatttcatcgattgaataaagggcacgtcccatttcagtagaagccaatgattcataggcgatgatgattggcttggtgattttttgatccaaaagcagaatgtctagttcttcagtaaccatttctaggttgctgtattgaccgactgatatgattggcttaatgtcgttttccaaagcgttttcgagacgcttgcgaacgattagcaagccttcgttaagtgacttacgacgctccaagtgaccgatgaaactcgtcgtaataccaagcgaacgcaagacactaggtgaaatctcacccacggtacgctctttgatcgtcaaattttgactaatgacttcgaacttatcgtggtcattatcaacaggcagcgtgggtgcgatttttaagtcaacttggacttcggcattatctaaatcgtttagaaattgcttttgaagttcaaaatcaactaagtttttaaaatttagaacagctaacattgatttatcctcccccaaaggtaacgttgttatacttttcgattgattacttgcagtataccccatatttctgatgaaagaatggctgataatcgaataatggaaactgagtcatgaaaaagccacgaaaacatggtttaatttaattctggggggaaggaaatgaaggtatatcacgtaaaatggattttaaaagccctatcagttattggtatcttactaacgatttgggctgtgtttaaactttatcagatgggcgcgtttagcaattcaaaagtattgattgaattgctaaagggatacggaattttggcgccaattgtttttattttgattcagattatccaagtggtcattccagtgttaccgggtggtgtatcattggctgccggtgtgttgatgttcggtccttggtggggattcctgtacaattatattggtattgtattggggtctttggcattgttcgccttgggaaggcgcttcggacaccgtataatcgacattttcgttagcgaggctacgcttgataaatatatgcaccgtctggattcgaaaggctggcacatcacgtttgcgttgcttattttcgcaccagttgccccggatgatgccttagttttgttaacgagtttgacgaaaatgacttggcgagaattcacattgatcattttgcttggtaagccactttcaatacttgcgtatagtttggggatgctttacggggctgattggctaatgaattttgttggtaagtagcgtatttgagacataataattgtaaagattattacgacgatattcctaactttttatgcgttaattacaagtgaagttcggtaatgaccgcatattaataaacagacatttgtccttgtacgactttaaacaattaaccccgtgaaacctaggtttcacgggggtttatgttacatttcaatgtttgctaaatcgttaagatttcttgataatagataagttgagtttttctatttggaggagatgacaccatgtcacatcacacacaagctggccgtcaattaacgacgggaagcttggcagttgctatggttcctgcgatggtaatttccgcaggtctaacagcacttatggcagcgaaagcatatgaaatgattcggctagcaaatgcgaacggaaaagtattagaagagaaagcgaagcaagcaaatgattaagcgtgtatttacgtatctaaaagatgacgtcatgttcacggttagtatgatacttgctgttgggacgtctttctttgtaacacctgattttgggtctgttaattggcatactattttcagtttgatgtcgatgatgatttgggttggctttttggaacgagcgggcgttttgcacgccgtctcagtttggttggtcagccgtagtcaccatgcgcgaacgctgatgacttctgtcacattcctatcgttcttcggagcgatgttcctatcaaacgatattgccattttgaccttgatgccaatctacctacgattggcaaaagatctttcagttcgattgaaggtcatcgggtcaacattggttattatggcagccaattcaggggctatcttgttcccatttggtaagtcacaaaacttgtacatgtacgggttctatcacgttagcgttggacaatttttcaagtggtcagtgtcattgacgttggcgtcattggttttgatgttcatcattacgcgattcgtgcgtgcgacgccgttggaaattaagttgaagccagctgataagctaaatcatggctcacttgtatttttagcgattaccggtttgattttggttgcaacaatctttggctggacgccatttaatgttgtcgtgccattgattctggttgcgtttttcatttacaaccgctcaatgttcaagatggtcgactttggcttactagttacgttctttttcttcttcattgcgacaaataatttggcgcacatcaaagttatccgcgaactagttagctcattgtttgacaccaagtcacacgttctattcggaacgttcttcttgagtcaattcatctcaaacgtaccatcaacaatcttgatttcaacattcaccgatcatgcgcgtgaattgtttattggatcaaacattggtggattgggaacggttgttgcctcaatggccaacttgattggattccgtgtgttccgtcaaattgaaccagactcatctaagtcattcatgaagttgttcatggttgtgaacttcgtcatggcagcaattttgctggtgatttttggaatttaataattaaaacggctgttgctcattttgttgagcaacagccgtttttctttattcgctacgagctggcaattcgacgctggcttctgccaaaacgtggccaactaagtctttacggagttcgttaaagaaatagccgggcgtcaaatcaagcgttgtatcaacggcgtaaaccgttaatgtgtaatcgtgcgtttgatcaggtggcattggaccaatgtatgattgcgtaatttcaggcttgctgtgcttgaaaatgctgtacattgagttcgtaccagggacaaatggcacgtcagatgtcgttaggttttctggcacatcacccacagggaggtttgccactgtccagtgaatccatgggaagcccccaactggaattgcgtcataatcaatgaacgcaatcgcgagtgtttcagtaccagctggcacgtcgctaacggcgatcgggaaattaacaacgggattatcttctaaacgatattccgctggtgcaaacttggcatacttatcaggcaacaagccttgattatcaagcgttacggatactttcataatgtgttcctccagatgcttttgctgtcagtttaccacagctgccaaacaaaagtgttgacggaaaaatggcagtcatgtattctaaagccacatacgaatacgataacctatcaagagttcggtgagtgataccacacgatgacccgacagcaacctacagcgatgcaaggtgctccactggtaacggataggtgctaatgataacggcacctactggttttgtaggtgtcgtttttgctatgcaaaaatatttttaggatggtaatcgtaatgccaacgattaatacagatacaatgcaagaagcttcaacggtaagcttgatgatggatatggaagaactgacgggcaagggaatgtttggttcgatggcacgtaggcaacgaatcacacaactgtggaaccgtgcgaagaacaatgatgcattggcacaaaagttcgtcgccgataatccagccatttttgacgtgatgaagccaaaggcgccagtaacgactgcacttgaggacgcagctttgtctttggtgaatcttgaggaacgtgttcacgaactagaagaaacaatcagtcggcaacgcacatttctgttgggaattttttcagaagaggagctagacgaatccgtcaatcaattgcgtctaaacgctgtttcacgtggaactaattatccaaagttgcaggactaaatcaaactggtgtaagcttagtccactaatatgaaagcatgagatgaggttttgagatggacttggcacttgatttggcacgcacagctttggttgtgattgatgtgcaagacggcattgcgtttaagggtgaagcaaccccaaatacgccagaacaattggtggcacgcaacaacgagttggcgtcagctatgaagaatacggcagctcaaattgtgttggtacgtgttaagaatgacggtgcagaaggatttaatcctgtaactgatgcaccatatacaccagcgcaaccaatgtcagctgaggcgacacgtttgtcgttggatattgcaactgatgaaacggctgaaaatgtgattgttgtgaacaaacacaactggggtgcattttacggcactgacctagatgtgcaattgcgtcgtcgtggcatcgacaccattattttgacgggtattgcgacatcaattggtgttgatacaactgcccgtgaagcagcccaacgtggttataaccttgtgtttgtgccagaagctatgacggatcgcacagtgcaaggtcacgacgcttcagtagaggtgattttcccacgcttagggaaaattcgtacggtcgcagaagtgaagacggcaattactgaagcaaagtagaaggagagtctggacttcacgttcagacttttctgtttttcggactagcgtctggctaatctgggcaaatggcgttaatatggcaacgataacaaaaagtaaggaatggtaagagacgtgattgaatttcgcaatatctcgaaaatttatcaaggtaagccagcggtctcgaacctaacgttggatattgctgacggtgaattgtttgttttagttggtccaagtggtagtgggaagaccacgtcaatgaagatgattaaccgattagtggaaccgactgatggggatacgtacgtacgtggtaagcgtgcgattgagtacgacttggttgaactacgtcgggggattggctatgtgctccagaactcagccttatttcctaatatgacgatttttcaaaatgccggtattcaattggaagcagctggtgtaccgctagaacaacgtcgacaacgcgtgtacgaactgttgaatcgagtcgggttgccagcagaacaatatgcggatcgcatgccaaatgagctctcaggtggagaacaacagcgtgttgggattgtacgtgcgctagcgacaaagccagatatcattttgatggatgagccgtttagtgctttggatccattgtcacgtcgttccctacaagatttggtgctggaattacacgcggatttgcacaccaccattctctttgtaacgcacgatatgagtgaagcgacgcgcctaggaaaccgcatcggtgtgatgtatgatggcgttttgcaacaagttggtacgccaacggaagttacgacgcacccagcgaatgaactggttgaagcgatgtttagcgagcgaccagcaaccatgattcaggcaattttggatgctggttttggtgaaccaatcactggattgggtgacgagccacagctacaagcaactgattatttggctgaattatcgaagcaactggttgatcatccggcggtggtgattaatgggacgaccaagttgacggtgcaagatttgttgcagtatttggctgcgttttagagaaagtagagtgtggggatgttagcagatatgttacacatgctgacaacacaatctggcgatatattgacggcgttgcgtgaacacgtactgctttctttgttagcgattgtgattgcagcaatcattgccctgccattggctatcggtttgatgaatcatcgccgtgccggtgagtgggtgcttcaaatcgccggggtcattcaaacgattccaagtttggcgattctaggagcgttaattccgtttgtgggtatcggaacggtgccgtcagtcattgcgttagtgttgtacgcgattatgccgatttttcaaaacgcctatgctggtttgacggggattgatccaacattgttggaagcagcagatgcgtttggcttatcgaagcgcttcaagctgttccgcgttcagttgccgttggcaatgccgatgattatgtcaggattgcgtattgcgatggtgatgattattggaaccgcaaccttagctgccttgattggtggtggcggtttgggaaccttcattatgttgggaattcaaaccaataacaacgctgaattgttgttgggggctatcttgtcagctttgttggcgttggtattctcttggggtattaagctactaagcaagttgtcactaaagcgtatcggcattgtaattgccagcttgattgtgatttttggtggcgtcgctggttatcgtgcaattgttcaaccagccggcacaattacgattgctggaaaattgggtggtgagcctgaaattctaatcaatatgtataaggatttgattcagcaagataatccacgcttgaaggtgcaactaaagcctaattttggtggaacgacgttcttgtataaggcgttgaagagtggtcaggttgatatttatcctgagtttaccggaacggttttgcaatcattagttaagacggatggtcatattccacatgatccagttacggcttatgagcgtggtaagaagttgttgaagcaacaggataatctggattatttgcaaccaatgaagtatcaaaacacgtacgcgttggcggttcgtaaggctgacgctaagaagtatggactgaaaacgacgtctgatttgaagaaggttgatgcccaatttgcagctgggttcgacccggatttcgccaagttgtccgatggttaccctggtttgcaaaaggcgtatgatttgaacttcagcaaggtcgtgacgatggaatcaagtttgcgttatgaggcagttgccaataagcaagttgatgtgacggatgcttatacgactgatccgcaattgaagcaggatgatttggtgtcgttgaaagacgataagcaattcttcccaccttaccaaggtgcaccgttggttaacgatgcgacattgcagaagtatccaagcattaagaagagcttggataagttggctggtaaaatttcagaagatgatatgattcaaatgaattatgaagtgacggttcagcataaaaaggctggggatgttgcccatgattatttgaagcagcatggtttgatagactaaatgaaataaggtgctcagcagtactgagcaccttattttttagtttaagtagggtaatagcgtggctaaatccgtcgtgtcgttgtccggtaataaaaatttggttgccaagttatctggattaatattataaaagaattgtcggcaacgcccgcatggcgcataaattttcccgctgtaatgaacagcaacgcaacgaacaacgcgagattcattatgctgaatcatatcggcgattgcaccatgctccgcacaaaaccccaaactgcttgaggaatcaattgaaacaccagtgtacacgtggccgtcctcggtttctaatgcacatgcgacggaggcgacataacaatgtggtgtcagttcacgaggatttgctttttcttttgctaaattagttagttcttcaaatgtcatttttggttccaactttctttctgtaaagcgtaccataactaaaattagaaaacgatgacaaaaattgttgacaaattaaaagtatgagcatatcataatcaacatcaacgaagacgagatgtagtagcgattgaaaaatctgcagagagctagcgtttggtgaaagctagtgattggcaaatcgtgaaaatggtctctgagttagtgtgtgactgcgagcaggttctgtaagtggttaccgggtgcgcccgttatagcgccaacgtatttccggcggctgtcgactagtccagcttgaaggcgtacgtgtaagcttatttgggtgactgaataagaaaactgggtggtaacacgagtcatttcgtcccggggattgtgtcataagacacggtccccgggtttttgtttattcggccaaataaacagccatcaaagataggttaatgaattgggtttaaacggagagtggaaattatgagcaagaagattattacaagtgcagttctagcattggctgtggccggcgcagttatcccagcaacatcagttgtggcatcagcaaaggaattgaagacggtgaaggtgggaattaactcaccatctaagacagatcaagccgtttggaacatcgttaagaagaatggtgagaagcgcggtatcaagattaagttgattacctttacggacttcaaccaaccaaacgcagccttgaagcaaggtaatattgatgcgaatgcgttccaacactacgccttcttgtcagattggaataaggcacacaaggcagacttgcaaccagttggtgagacggttttgggacctggtcgcttgtactcagataagtacaagtcagtgaaggatattccagatggcggtacgattgctgtggccaacgacccaactaacgaggcgcgcgctttgttcttgttgcaggcagctggcttgattaagatcaaggaaggcgttacaagcccaacggttcgcgacattgtttcaagttctaagaatttgcacgtgaaggaattggcagcggatcaaacgttggctagcttgaattcagttgacgccgccgttatttcagccacattcgttgaagcagctggtcgcaacccgaactcagccatctacgtttggaatgcaaacaacaagcaatcacaccaatgggtgaacattattgcagcgcgtcatgatgatgctaagaagtggtatattaaggctttggtaaagtcataccaaacgaaggaagttgggcaatacattaacgaccacaacaatggtacggaaatcgcagcttggaagggtgcacctaaggctacggttgtgacggccgatacggctagcgatgcgtcatcagcatcatcaaactaatcacaaaatcgaggggatttgaatggcaacagcactaggagacatcaggggaatcgcacgtccaacgattgttggtcaaacgctatatgcgacggaaagtgtcgcggacgaaattgagaatcgttatcaaacgaatttggtggttgtgaacgagacggatacaaccacgttggtaaatgacgcgaccgatttgcaaggaacgacacaggccattttctatcagcatgatgggcaactataccgccgttctgttgatggcgaaacggtgcaattgacgcatcaaagcgatcatatcacgagttttgtaccaacacctgatggggcaggtgttgtgtttgctgttcaagttgaaacgcaagcatcgtttaatgccgtcagcgagcgaccaacggtgcgatattatacgaagcgtcattataaagatgacggggtgggctttatcgatgagcaacgtcgctttgagatttatcaagccacggtttcaggggtgacacgtttattgggcacgttctcgttgccggttaagattgcagatgcgactgatacgcaggtagtaataattgtgcaaacgaatgatgagaacgctcacgaatatcgttcagaattacgcacgattgattttgaaactaagacgcaaaccaaagtgcccactaatttggcacaggtgtatgaagcgacaattgcaccagatgcaacgcagattttgattctcggcaacgatgctcaatatcctaatcgacgggcagtgagcctgcattattatgatggtcatcaaacacgattggtttttgatgacgaagaattgttagcagaacctaattctgatgtcattgtgcagggacaaggacgccatgtgcgttggttagattccgaaacctacatctttgagacggggtatcacggacatacgcgtctttatcaaggaacgatagctggcgatattacgcgattactggatgagccacaattgctaactgattttacgattgctgatcgagaattggtgattacgcaacaagatacgagccacccaagccgtttgattacagtcgatttagacacgcatgcacaaacggtgcgttatgatgctaatccgacgttgtcgtttacggcagctgaaaaattcacttttgatagtgaagacggttcggatgtggatggatggttcttgccagcgcattcagaggagccggcaccagttgtgctatatgttcacggcggtcctcatggagcttatggggatgcgttcttctgggaattccaacgttttgcggaagcgggatacaacgttgtttttacgaatccgcatggttcaacaacatacggccaagcgtttatcaatgcggtagtaaaccactatggcgaacaagattatcgcgatgtattagcgggcttagatagggctattgaacgttattcagataagattgatgcgacccgacaaatcattattggtggttcgtatggtggctttatgacgacttgggcaattggtcatactgatcgattccaagcagctgtttcacaacgaccagtaacagagtggctacatctaacaggtgccagtgacattggatataactttgtcgctgacgaaatgggcgcaacgccatatacggaagctggtagagcagaattgattaagcgctcgccaattacgtacgctggggcggttaaaacgccactactaatgatgcatggtgaatatgatttacggacaccaattgcgcaaacggaaatgtatttcacggcggtgaagaccttgacggatacgccggttgaaatggtgcgtttcccgcagtcatggcacggtgtgtctcgtaacggattaccgaacttacgtaatgcgcgattgaccgtcatgtttgaatggttagacaagacgctcaaataataaaaaatcagccatctctcaacttgtgttgggggatggctgatttgctatatgtatgtcaatttgggtgccgatgtttcacgtgaaacgttggcgaatatgtatcgttttaaaaacggcaggtgattttaccatatgtttggggaaagtggtcaagtttgaccgcttccgtgaatctttaagcgagttgaggtgtgattgtattgttgatccaatcagttagttcatcaataccagtgcccttgtgagaaactggatggctgaacccctcgttgatgaaatgccaacttgcagtttgaccatcattcccataggaaacgaagtggatcttcagcgaaccgttttcccagttgcgaatgagtgctgggctggcttgcgcaccttggtaaaaggtgaagccattagctgcagcaaaatcagcgacaagttgtgtgtaaatattttcgttcatcagtatgctccttgatttttataatctgttcacgacaacattggtaatattcagttgtaaatgtctctccttccgttggtatatctatcattataatgacgaaaaaaataaatggtagtctagtaattattgggtttcatgctaaaatcacctgccaaaatgaaaatctcgatgagtttttgataactcatcgagattaggcatattatttatcatcgacttcagtcttacgattcaattggcttaacataatacgagtaccaaggttttggataccatcaagcttcaagtgatcgcggatgccatcgttcatcttatctagcatggctgcgagttgcgtccattcttctggggttagatagtcgaggtattcggggatgtaaaataaactcttttcagcttcgtggcgccctttgtcagtgagctgaattaattgaatacgaccatcagttggggattttgtcttagtgacaaagtcctttttaactagcttagcgacgaattcagccgttgattgcacactcatatccaagcgctcagcgagttccttttgagaaatattatcgccttcactcaacgcaaccaagactttgttttgcccacgaaaaacgggtgagtgacgttcaacttgttcatcagccaagtgctgaagtgatgtaaattcaaatagttttgctgctaattggtgtttttcgatcaaatcagccatgtatcttgccgtccttaaatttttctactaatgccagtataacagggttcgtgacgaatatgaactaaaatacacagggtacctgaacaaaatcgttgacatattaatcagggtaccttattattattttcgtcaggtaccctgataattaattttgaaaacaagaaggcaatatcatgagtgaagagtatgcagttgaaattgaaggtttgaccaagacatttggcacgcaaacggcggttgataacgtgtcatttaacatcaatcgtggtgaggtgttcggtttgcttggaccaaacggagcgggtaagacaaccacgctgcgcatgatgacgacgttgctaaagccaacgtcaggaacgattcaaatttttggacacgatgttaagaaggaacctaaggtggttcgttcgttgtttggcttgactggtcaatacgcatcggttgatgaggatatttctgctcgtgaaaacttgatgattttctcaagcttgaatggtttgtcacgacgcgaggccaaggaacgtacggaagaattattgaacgagttttcattggtggcatcagctgataaggcgatttcgaatttctcaggtggtatgcgtcgccgcttggatttggcggttagcttgatttcacgaccagcgttgattttcttggatgaaccaacgaccggtcttgatccacgcacccgtacgcaaatgtgggataccattcgcgagttggtcgcagaaggatcaacaatcgtcctaacgacgcagtacttggaagaggctgatgaattagctgatcgcatcgcgttgattgaccacggaaagttggtcagtcttggtacgccagccgagttaaaggcccaagttgggggcgcaaagctacgtttggaaatgacggatgcacaacaggccgaccaggcaaagcaaatcgtaactgacgcattgcatgaagaggtgaaggtggcaaatagcaccgtcacagcgccactacgcgatacgaatcaggttgcaggtatcttgagccaactaactgtagcggggctcacaatgacgaatatggccgttgaacaaccatctatggatgatgtgttctttgctttgacggttggaaagaattaagggaaataagaaggttagaatcatgatggatgtacaagcacacaagacaaatattattgcaaacacggccacgatggcataccgtaatttgctaaagacgttacacaacccagacaagtttttggatgttattgtgcaaccagtgatgttcatgttgatgtttggttacctatttggtggggcgattgccggtaacgtgcacgcttatttgccaacgattgtgccaggaattctcatgcaagcattgatttcagctgcatcaggttctggtacccaaattagtgacgacatgaattcaggtatttatgatcgtttgaagtcattaccaattgcccacatcgcaccattggctggacaactatttgcagatattttgcgtttgtttatcgctgcagttgcgtcattgacgacgggattcctaatgggatggcgtccagccgctggatttggttgggtagttgtcgttgtgttgctagatgtattcttgggatgggccttgagctgggtattcgctttgtacggtatggtcgccaagagttcaacaatggtcgaaagcgtttcattgattacgatgcttttgctaacatgcctatcaagcgcattcgtacccgttaagacgttgccacatgttgtgcaaattttggtaaacctaaacccggtaacatatgtcattaaggcatcccgtgtcatgctaaaccaaggtgtttggtcaaaccaagcctggattgtgcttggcgctggtgtgttggtggttgcaatcttcgcaccgctaacggtgttggtttataaccgtaagaattaataattaaaagccctgcatcaaggtcattttgaaccttgatgcagggctttgctgtttatttaaggattattcccattcaacagttgcaggtggcttagccgtgatgtcgtagacgacgcggttgatgtggtcgacttcgtttacgatgcgacgagaaatctcttccaagatgtcccatggcaactttgcgaagtcagccgtcataccgtcgactgacgtaatagcacggatggcaatagtgtagtcgtacgtacgaccgtcccccatgacaccgactgaacgaacgccagtcaataccgtgaagtattgccaaacttcgccgtctaggccgtgcttggcgatttcttcacgcaagattgcgtcagattcacgcacgatttcaagcttgtcttcagtgacgtcacccaaaatacggattccaagaccagggccagggaatggttgacgccaaacaagttcgtgtggcatacccaacttttcacccaaagcacgcacttcatccttgaagagtgtgttcaaaggctcaatcaattggaattgcatgtcttcaggcaatccgccaacgttgtggtgtgacttaatcgtttgggcagtatcagttcccgactcaataacgtccgtgtacaacgttccttgcgccaagaaatcgataccgtcaagctttgcagcttcttcgtcaaagacgcggatgaattcgtttccgataatcttacgcttttgctcagggtcagtaacaccggcaagcttagataggaaacgttcttgggcatcgactttgatgatgttcaaaccgaacttaccaccaagtgatgccatcacttcatcagcttcattcttacgtagcaaaccatgatcaacgaagattgatgtcaattggtcaccgatggcgcgttgcaacaacaccccaacaactgatgaatcaacaccaccagaaagtcccaacaagaccttcttgtcgccaaccgtttcgcggatttgcttgatttgttcgtcgatgaaatcatccattgaccagttgcgctcagcgcgaacagccttgtcgacgaagttttccaagatttgcatcccgtattcagtgtgttgcacttccgcgtggaattgcacaccgtagaagttgtggtacgtgtcttccattgcggcaattggcgtgctgtctgacgttgcaaccgccttgaagccatcaggaacttgttcaacatagtctccgtgtgacatcaaaacagtttgcttctcaggtgtgttaccgaacaatagcgcgctatcgtccgtcacattcatttcagtttcgccgtattcagctgaatcgttagctggtgcaacttttccccctggcaaaacgtgtgccatgagttgcataccgtagcagacacccaaaataggaatgttcaagttgaacacctctgggtcaattgtgaaggcgccgtcttcgtaaaccgaatttggtccgccagagaaaataagtcccttaggatttagttccttaatctcggctgccgtcaaagtgtgtggctttagttctgagtacacacccaattcgcgaatacgtcgtgaaatgagttggttgtactgtgatccaaagtccaaaacaagaatactgtcgtgtgcttgtgtgtttcccatgatgtcccccattaataagttgtttctaattatacgtacttgtcgatatttatcaatgataacttttgggaatgttcgtaatttgttcacatattacaatgttctcataatcatagttactaaaaataagttattgacgaaaaatacttattttaaagggttcatacgttgataatcaggttaatcgtttttaataattcaaaaccaatgatttttgtaatgacttagcccttgcattatcttaaatacacctttatagtggtaaaaattaaatttttatatggactctgagttggccagttttggccgacaaaacgagtggtcgggtcgagggattttatacttggaggtattaggaaaatggtttcacgtcgtaacttaattattggtggagtagcgcttgtcgcggttgcaggaattgcatacgcagcaacgtcaggaagcaacggtggttcaagtgataagttcactgctgcagttgtttcagacacgaacggtgttaacgataagggcttcaaccaaagcgcctgggaaggtttggagaagtggggtaaggaaaatggcttggaaaagggccaaaacggatacaactacttccaacctaagacagttgcggattacaacacgcaattgacgcaagctgcaacggctaagtacgatgttgtcgcagcaatcggaaacacgtttaaggactcagttcaaactgtttcaaagaagtacccagacacgaagtttgtgttggttgacgaaattgctggtgctaagtacaagaacgttgcgtcagtaatgttccgttcagagcaatcatcatacttggttggtgtggctgcagctacgaaggctaagacgatgggcgataacactgttggcttcgttggtggtatgaagaacccagttatcgaagcattcttggctggttaccaagccggcgtgaagtcagttgaccctaatatcaaggtagatgcaacgtatgctggtacgttctcagaccctgccaagggacaaacgattgcgaaggctaagattgcacaaggtgagcacatcatcttccaagccgctggtggtgttggaaacggtgtcttccaagctgcgaaggatcaagacgcaacgttggctgccgactctaaggataaggtatgggttatcggtgtcgacatggatcaaactgacatgggtgcctacaagacaaaggatggcaagtctgataacttgacgttgacatcatcattgactggaatcggtcgtggtgtgcaattggttactgaagctgcccaaaaggacaagttccctggtggtaagacggtctactacggtttgaaggaaaagggtgttggtgtcacaactaacaacttgaacgcagacgagaagaaggctgttgaagatgcaaaggcaaagattattgctggcgacatcaaggttccagaaacgcctgaaaactaattaatataagcgaaaaccgcgatgaacttgagttcatcgcggtttttttagcgtggaattaaaccagcagtaacgctggttgccttcgcatcttcgtattcatggtgattaattttgtcattatctagcatcgcggccagcacgatgttacgacgcttttcaactaattctggattgctgtacaggtcgaagtttgatggactctgacccaaaccagcgatgatggccgtttgtgacaacgtcaattgagacaaaggcttaccaaaatagtagtaggcaattgtttgcgcaccgtattggtagtggccttcataaattttattgacatagtattccaaaatttgtgctttggtatgtgttttgttcaactgaagtgccagataaatctcttgaattttgcgggttggtgtttgatccgccttgctagttgagaaaacggtcaacttaacaagttgttgggtgattgacgaaccgccacgagcgacgccatcgccaaagcgagccttgatgtttgaaacaaccaagttgaatacgccacctaagctgacaccgttgttcgtttcgaacgtgcgatcttcggttgaaatcagagcattacgatagtcgtccggaatgttgtcataagtgacataaacttgattgtcaccgggactagggttcgctttgagggctgattccgtaatggttggcgcttgatgaatggcgtaaccaacgtaggccccgcccgctaatagcatgatgacaatgatggttgccagccatttcagcaggtttttaactggattgtgtcgttgtcgacgtgttttgcgactcgccatcggcaaatcctccataagcattatttctgatagcatacggggaatttagtttaaaagcaacgccaaactgttagtgacttggcgtaagcgtaacagttaggtggttatcagaatcgacgaaagcatcgtatgcagcggtaccgttatcgccaaggaagtgttggttgtggttatccttggcttccaagaaagcgccgataaatgaagggtgcatccagtgcataccgaactcgaatccttggaatgtgccagggtagcgacgatcatttgcgtcagcatcaaaacgaatttcagtaacgccgtctgcggtattcgtgatgctcatttgaagtccagcttcattgatgacttcggtcgttccaactggtaatgatgcaggaatggggtacgtgatggtactcgtgttgttatatgcagatgcaagcgtttcatattgtcctaaagtcatcatgatggtggcctcctttgttttgttgccatcattatcgttcgtccttaacaacttgtaaaagaaaaaggcacgaaatttaggtagactgggccttaggggggattgaacaatgaaaaaattcaaaaaaggtattggattcccgagcgttgtactgctaggtattaacggtgttatcggtggtgggctgtttttgctaccgagtacgatgtacaagcagggtggccaatacgtcttattggcaattgctttagccggtatttcagcgacgctaatcgcgatgcattatgctgtcatgtcatcgcgaattgatgaagatggtggtgcgtgggtgtacaccaagcgtgcctttggacactacccgggattcttggtcggttggtttggctggcttttcggggtaattaccatcagtgctgaaacggcggcctttttaaaaacgttaacaggactggtacctgcggtcggaacgccgttagtctacaatagtttggctatcggcattatgctactgctaggtatcatgaattacttcggaaccgggattgcgagtcgcatagatgatgcgtccagtttgataaaaatcggcgtgattctggcggtgttcatcgcgacagttgtgtggttgctgttggggagcacatcgcaattctcaatcgcacaagcgaaaccggtgcatgatttctcaggtgcctttggaaatgccttctatatgtttactggattctcactgattccaatcgcggctaaagagatgaagaatcccggcaaaatgttgccacgtgcgattttgaccgtgatgttagccacgacggcgattttcgttttgatgcaagttgtcgcaatgacagttttgggtgatcatttggctggttcagctttgccggtcgcggacatttttaatgttattttgggacgtgtcggccgtacgattatcattactgggatgatgttgtcgattatcggggttgcgattgcgacatcgtttaattcaccaattgaattggcttcgatggcccgtgaacgtggcttcctaccgcgtgaattctcgcgtttgaaccgttatggcgcaccggttggggccatcttgctgacgattgcaatatcaggtggcttgattttgagcggtagctatctatttttgatcaaattgattgtgctgagtgatttcgtgcaatacttaggaacaatcttctcatcgattaagctgcgtggtgatgcgacattgccaactggttataagttacctggtggtaaatggatgacttatctgacgattgtggtggtcgcgtatttgtttacaacctttgcgattacgacagttctggtcggtattgggtttgcgatattaggcacgattatttacagtgtggaacaacgtcgccactaactggcatatcacttatgaccaaaaaatttggttgtgagtgatttttttattgcccggaaaataactttctaaagtttcatagtcaattcttatggtagttaaaaatggtttaagggcgaggttttgtaacgtgttctgaataatgcaccggtatcatagggagtgaatattttgtaggattgtagacctctacgaaaataggagacattaaatgattaataaacaaattttgacagcaatgacaactgcaggagtcgcgacggttgctgttggtgtgaacgcatcagctgatacatacacggttaaggctggtgatacgttgacgagcattgctaatgcaatgggaacgacggttgaaaagattgctagtgataacaacattgaagatgcgaacttcattttgatgggcgtgtcattgacggttaacggtgatggaacggttacgccagtgcaagctgatgcagatgcgacggcaacgacgacagctgccccggttggtgtaaatggttcatacacggtgaagaacggtgatacgcttttcgccattgcccaagcgaacgatatgacgttggctgatttgttggcaattaatggattgacggcgaacgatacgattttcatcggccaaacgatcaatttggttgcccaagctgctccggttgccccggttgttgaaagtgttgcgccagttgtgacgtcagaggcaccagtggtatctgaagctcctgttgtgtcagaagcgccagttgcctcagaggcaccggtagcgtcagacgtgtcagaagttgccccagttgctgaagaagcgtcagaggcgcctgtcgtggcagcaccagcgtcaaactacgtcggtgcaccaacgcaagctgattcattcacgcaaacgacggactcaggtgttacgactgcttaccaaacggctgaagtagtggctgaaacgccagcaccagcagcaactggttcagtttatgatcaatttattgcagccggcggaacggatgctttgtggtcaaacattgtgatgcctgaatcaggtggaaacccagatgccgtatcaccaaacggttacctaggtttgggtcaaaccaagcaatcgtggggaactggttctgttgcagaacaaacagctggtatggttaactacgctgtgacacgttacggatcaatcgataacgccgtgtcattccgtgttgctaacggttggtggtaatataaaatttcatttagggactcgcatttttgcgggtcccttttcagttatcgcaaggtcttaaccgttatgcgcgagatttttttgaaaaaacataaaaaattcatcgtggtgaaagttcgggcgacaatctatattgaaagacgtactaagaaaaaatatatggaggtaacaatatgttacgcaaagtattattgcaaatgacgttggcgtgtatcgctactggagttagtgtaggttgtgttagccaagttcaagctgccaatcacggtgggaagcacacgagtggcacatcttggtcttatcgccacgatggattgcctatcaagacgtgtcattcaaattattatcacccaagcaggcgacatgcagctgtagcaacgatgtctggtaaaagtagtgtagtgtgggctaatgctgggcgcacagcatctgcatccgtatccgttggatacgggggaacttgctacgctcagtataagttttagtgacattgtatgaaaaaattcatcattggtatttttatggcagtcgttattagtggcataggtcttgtgttcttggttattaatactgataagcaaggggtgttaacgcgatcggaagttgaacattggactaacatcaccacgcctaatgttcagacgaattatttagttgcttctggtattgggcgattgatgggtcgagttgattatcgcgccagtaagaaaatttcgggccaggctattcattggaaaaatcagacctatttgtacaacgctatgggtcgagatcaatttaggcaaaatagccaaagctacgttgatggtagttggcgagatagtgagaatgggcagcgattattgcagtttaacgggaaaacacaggagcgttttgttagagctgatttttcaaaatttcatgataatgatgttgctgagcttgctgtgacatttaaatctgagttgacctatgacgaaattaaacgggggatgcccggaagcgtggctgttacttggctgtggtcaggggttgccactggtaacgcagagtatgtaggtgttccaatcggaaaagaagatccaacgggtgactaccgatattatttaaagtcttataatcgtttcaaatcgcaaatgtcatggccaaatcaggtaccaaatttggctttagcgaaattccctggtgttgttattacgggaaacattgcagatttaaaggcactggagacgtctgataaggtcgataaggtttcattaggtgtagtgatgtcctcatcggaggggtaaattatctaactatttcacaagctggaactcagcaatttactttctagaagcgtattatatctatgacttttagagaggtaagctgaatatggaatcttatgaattgcagcaaaacacttatgcggtagaagagcaaaatcgtcttttggcacagcaggcggcagaactagcaacgcaaaatgagttgagccaaaaagacttcgaactccgtcgccaagtgatgatgatcgagcacccggagttacgcccaatcattgaacaacaaatgcgtgaagaagcagaagcaattgctcgtcgtaagcgacatgattttattggtagtttgattggtgttgttattttaggattaatggtagggtatgggctgccttggctgttgaacagtggtttaatttaaatacgaataaccgattagtcgtgaagggctaatcggttatttttacttcctacatgttagaatagaaatatcttatagaaagagcagatgataagtctttgtagaacgaaatggctgaagaaaagaagcgtcgtccttaccaaggtaagggtggcaacaatcaaaatcgcggcaagtttgttccacgtggaacacgtggacctcgtcgtgataatcgcaatcaacaaaacgtcgaagttaacgttggtgacaagctgttgattaccatcaagcgattgggaatcaacggcgaaggaattggttactataagcgtaagattacgtttattccaggagcacttcctgatgaagttgttgatgttgttgtaacgaacgtcacagacaagttcatcgaagcgcgtgttcgtaagattaagcaacgctcaccaaagcgtgttgatccagttgataaccaagaagttggtggctttgaattggaacacttgtcttacgatggccaactagaatttaagcaagatgtgattcgtcaggctttggaaaagtacaagcctgaaggatatgaacagtttgatttgcgcccaacgattggtatggaaaacccagacggttaccgtaacaaggcgcaattcccggttcgtgaagttgatggtaagttggccgtgggaatgtacaagcgtaattctcacgacttggttgatctgccaaaggtttcaacgcaacacccagcaacgttgaaggttgtgcgcaaggtgcgtgatattttggctgatatggaaatgccaatttacaacgagcgcaagaattcaggaattgttaagacgttgattgcccgtgtgtcagaaacgacaggtgatgtgcaattgacgattgtcacgaacggcaagtacttgcctagtgccgatgaattgattgcccgcatcaacaaggaattgcctgaagttgtgtctgttcaccagaacatcaactcagacaagacgtcacttgtttggggtgaagataccaagttgttgtggggtagcgaatacattacggagacaattaacggtaagacgttcaagttgtcaccacgtgcattcttgcaattgaacccccgccaaacgcaacgcttgtacaacgaggccatctcagctcttgatttgacacaagccgataagttgattgacgcctactcaggagtcggaaccatcggtatttcattggctgatcatgctggtgaagtacgcggtatggatacggtgcctgaagctattgatgacgctaatgaaaatgcggcggataacggtgttaagaatgctgcctactacacaggtgcagctgaagatttgattccacgctgggcaaatgaaggctgggtggccgacgctttggttgtcgatccgccacgtactggtttggatgaagaattgcgttggacaattttggaaacacaaccagataagtttgtgtatgtgtcatgtaatgcatcaacgttggcccgtgatttggtcgacttgacgcgtgtttatgatgttgaatacatccaatcaatcgatatgttcccacaaactgctcgttgggaaggtattgttaagtttacgaagaagagcaagtaagatagaggacgcgcaatttatttgcgcgtccttttttcagttgaggagaactgtttttcatgcgttgaagcgatacaatgaaaagtaacagggaaaacgagcacgacaactaaggggtggtaagaaaatgacattttcgattgaagtccggggtgcaaaaactaataatctgaaaaacattgatgtggatattccacttggccaaatgactggaattactggtcgcagtggttctggaaaaagttcgctggcgatggggacgctgtatggtgaggggatgcgacgttatttgaatgcattgtcgacatatacgcgacgtcgaattacacaggcaaatcgtgctgacgtgacaagtattcaccatttgccatcggctttggctctacgtcaacggccacaggtaccagacgtacgctcaacggttgggacgatgaccgaaagtttgaacgtgttacgtttgatgttttcacgtttagggtcgatggtgtgtccaaatggccatcgaatcggaccaacgttagccgttgcgatggatgttgatatgactgggatggattgcccagtttgtggcgtgcatttcatgccctacggtgccgaagatttcgcttttaattcggctggcgcatgtccaacttgtcaggggacgggtgaggtgcaacagattaatccagcattgttaatcaatgaaaagctgactattcgcgatggtgcggtgaattcatggcgcacccctggacgaacgtttatgccactggtggctgaggcagcgggcatcaatattgatatcccatatgaagatttgccagatgaccaaaaagacttggttttgcacggtgaccgcgatgaatatgaaattaatattccaagcaagagcggtaaggtgtttcacatggatcacgcggtctttgaaaatgcgacgaacgctattgaggacagtatgaagagcagtaaaaatgagcgcaccatcaagcgcttgaatcagttttacactttccaaacttgcccaacttgtcatggaacgcgttttaacccaaagttactgacgcagttgctacgagacaagaatattgctgagttgtcagagtacaccatcgaagaactagcggtatttattgctgaattgccagcaacgttgccggatgagatgcacaagatggggcaaaaactagttgatgagtttttggaattgctagatgcgccaattaagctcggtctggactatctcacgttagcacgcgcgggaagtacgctttcaactggtgaactgcaacgtattcaactcggacgaacgattcgcaatgaaacgaccggtgtgttgtatgtgctagacgagccaacggtgggactaaacccagctaacgttgcgggtctacttacgattttcaaaacactcttggaacaaggtaatacattggtcgtggttgatcacgatatgagcgtcattggcgcgagtgatcacattatcgaaatcggcccaggttcgggtgattacggtgggacggtgacgtttgcgggcagttctgctgatgcgaaaacgtccgatgcattggtcgcgccgtatctaaacggaacggctgatatccagacaagaacgcttgcatcacgagatactttgtttgatgacggtagtatcgatatcgcagtgactgccaagaataatttgcatgatgtgagcgcgcatatccctaagaatcgattgacgagtgtcacggggatgagtggtgctggtaagacgacgttaattctagatttgttggtgccaggtattttggcgcaaaatgaacaacaaccactacctgagggtgttgcgtctcttgatgcggcgggtgttgcgaatgttgtgatggttgattcagtgccagttggtaagaatgcgcggtcaacagttgcgacatacaccaacattctggataacttgcgcaagttgtttgctggcttgcctgatgctaaagaacgcggctttacggcgagtgatttctcatataatgcggccggtgcatgtccaacttgtggtggtgtcgggcacattacgcttgatgtgcaatatctaccagatgtgacgcaagtctgcccaacctgccaaggttcacgctatcgtgctgatgtgttggacgtaaagtggcatgaccgatcaatcgcggatttgttggcgttgtctgtcacggacgcgcttgaagtgttcaaggatgaaaagaagattcttaagacgcttgaaacgttgcaagaattgggcttggattacctaattttgggtgagagtacgcctgaactatcaggtggtgaagcgcaacgactaaagttagtgtcacaaattcaccaaaagcagggcgctagcttgtttatctttgacgaaccgtcagttgggttgcacccgctggatatcgagaacttgcttcacgtatttgatttgttgctgaaacaaggagcgacaattattaccattgaacacgatttggaagtaatggctaattctgattggttgattgatttgggtccgggcggcggtacgcacggtggtcaaattgtgggtgctgggacgcccgctgaactagccacgatgccagaaagtgtcacaggtcagtatttgaaggattatttggcgcaatatcaaaaagcataatactgtggtcgttagtttttgactgacgacctttttgtgatgacattagttaattatcaaaataaattaacaacttattgatacgctataaggtgatatattagtcgtaaataggaggtgtgagatgcgttcatggcgatcactggcattgcctggtggcgtgttattactaacatcagttgtattagttttaccgcaactgatatcgaatatgccgattatcggtatcgatgcgttgtttcactttaatcggttctatgatattgcggaacagatgaaacacgagcaatttaactacttcatgtcagaatatggctatcaacattccgggcggattgtcacaccgttatatggaccgtggctatcgtatttgatggggtttgtcctcatgctaatagcaaactggttttggtttgaaattgtaactgacattgctatcttgctagtcgctggtgtggggatttatcgactaggccgttatttgaaatctagtcgatatgccagtttagtgagtgcggttatctatatggcgttaccgttaacgacaacttggcaaacgagccaatcatttactggcatcggcgctgcgctactgccgtatgtggtgtattacggcattgcaatggctaaacagccgacaaccttttcttgggttggtcttgcgatatcgttggcggtactgacacaagcccatttattcacggcactattaggtgtcttggtattaggcattttatttgtggtgacggtgattggtaagaacaaggcaacaatcattgctttgatgcaacggttgctaaaagcggttgtcttatacgggttgctagtcgctaatgttttagttggtatggctgacgtgatggggagcaatcagattctaacgccatatacgccgttggatattagtcgggaaggaatgcgaatcacattatcgcaatcaccaacgctccgaaattatagttggcttggcgttatagcggtgattgtcttgatcggtgccgtgttggtttatcggaagttggcccgtgaataccgcttcttattttggctggcagttgtctttttcagtttgtcattaacggtgttcccgtggaatgcgattcaacagatcgaaccaacgattgttgatacgatgcaatttccgtcgcgtttgtcggtagttagcaacgtggctttggtactgttgttgccccggctcttggtagtgccggatgtgcaaaaacacctaaatcgccagttacgaatggtgattgttatgattgccatcgtggtaccagttgcgatttcctcaggtattttggccaagagtgcccatcggttgcatacggatgagctagtccatgtcacgaagcatacggcattcaatgagacgaaatcgaaggccgagattgcacgggaatggcgctatggtgatgtgcagaacgccttagcggatgtgcaaaaagcgacccctgattatctggtgaataacggtttgcaatcaggggataatagctatgacatgtatatgcgtgaggttattcagaacccgctaaaagcgcagataacgcaaggtaacgatgcacttacgtatcgttggcatagtcaaaacgacaataaaataacggtgccagttgctgtctatgcgcattccaaggtgattttgaatgggcatcaggtggcaaaaccacaaacaacacgtattgggacgttgcaggttcgaccacgggtcggtcagaataacgtgacgatttcgtatgacgtgtcaccagttattaaaatgatcattttaggcaacgttgtactttgggcaggcctcgtcattttcatgactgttaaaacaatttggcgtaacggttatcagattaaggtctgatagccgttttttgcgtggtatacttagcgataagtttctatttttagagtaagggaagtgtttgtgtgagtaagcagtggtatgtggggatggctgctggtggcgcgctattctggggtatcaatggtatcttgtcgaatatgttatttgatcggattgccatttcgccagattggttaacgaccgcccgtttgctgatttccggtgcagcgttgctgttgtattcgttgatccgtcggcaaaatatttttgcgatttggcgtcaaccgaaaaacgccgtcttattggtatcgtttgggttaattggggtgtattttgcccagtccaatttcgtgcgaacgttgtattacggtaatgcagcggttgcgaccgttttgcagtatatggcaccggcgttgattgttatttttctagctatctttcgtcataggtggtcacaacgacaagaattaatcgcagtaattctgtcgttagtgggcattgtgttgttggtaaccaatggcaatctggcgcaattgcaaatctcggagaagacgttgttctttggcattttgtcagcgctagggttagtcgcatacacgctgattccgggctctttgttggctgagaatgacgccatcgtcgttgttggttggggcatgtttatgggtggcttggcagctaattttgtggcaccactctatcaccccgcctatcatttcgatacgattgatttgatattgctgttctttattgtggtattcggatcgattgttgcatttgtctggtatattgcgagtctccgtaaagtggcgccggaaacggtgggaatgcttggcatgttagagccactaagtgcgaccattttatcagcgcttgtgttgggcgtttcatttcatgctttccaagtcgttgggattgtcatgaccctcggtgcaattttgattatgaatgtcgttaagaaatgacgaaatgcttgtggagctaatgctctgcaagcatttttttagttgtatggcaatgtttcttcatgtttttagaatacaaatcgagtagactggagggtaacaagtaacgtttttaatcatgacagtgacggaattagtggtgggggtaatgaaatgactgttttaacatttacaacaagtaataatcaggggcgtttgccggaagcacgcgagatggatgtgccatatagtgatgcgctttttgataagaatccagctgagtatcaacatgatttggcgcgagttagtgctgtgatggcgggttcgacgtacacgcgtgatagccaagttgcagggccaggatatgcgacggaaaatttgcgtgccttgggctttaagacagaatcacatggctatcatgtggttgatgatccaaataacgtggcgtttacgctgggttataagcgcgttggtgagaacaatttgtttgccgtgattattcgtggtacgccacaaaatgcggaatggtcaggtgacttcatgattggtgatgaagatgcaccaggcatggataacatgatttatatcggccaaaagattgcggcgcagttacacgaattcgtgatgcaatttgataatgtcggtcaggaaaacatcttttgggtaacgggtcattctcgtggtggtagtgcgacagaagtcgttgggaaaatgttgattgatgccggggaagaacgtgttttcgcgtatgcttttgcaccaacgacgacctacaagagtgctgataatattgactatgccgtgaagtatcaagcggttcatgccatcatcaatccgttagatgttgcgccaacattcccattggttcagtggggcttcacgcacattggccagcaacacattttgccagtggcagtattgcctgaagtggctaaggaatatgagcgaattaatggggtgccatttaagggagatgccaagcaagatgctgacatgctagatcgtggcttgcagctgtactacgctttggcgcctagcgtgcatgacttttaccatgcgacaacgccgtggtgggacggtcaaacaatgaccccatatcaatgggtgcaggatatgatgatggcaccgcaaggattggaaataccagagcgaacggctaatgttatggcatatgcaaagacgcatccggtgtatgctaagttgttcgaacatatggctaatggtggcatgggatcatacgagcatacagtaacgacatacattagtttcatggcagtattgccagatgattgggttaagtcatgattgaattagcagatattatttctgtcatccaaaatccgatcgttttcattcggccgattatggataatccttggctggtttatccagtactttgggcaattgtggcgcttgaaagttatttcgtcttattcgcctggatgccagccgaaacgacgatgtttttagctggtagtttagcggcgcatccagatattccgattgaactttggttgttgtggcttggttatctgccgacggtgtatcttggctggcaggcaaagtataagcgtggtcggaagcataagattaagaatgcgcgtatggacgatacagtcgcgttcttcaacagtcatgcatccttagcaatgctatttggccggtatattccagtgctgggtatttttatcccaattatcgcaggcgaaagtcagtatgcagctgcccgatttaaaaaccagaatgtggcggggaccttaatttgggtgctcggatcaaccgtaattggcttctttttgggctcagtgccgtttttccaaaaacatttttcaatcttgattgtcggtatcattattgtgccggcaggtatttactacctggtcaattttgtgaatagctttttccagcatatgcgtggataacgtgttgcattatatccttaacgtggaataatgggtggtgaaaagagggcgaatcatatggcagagaaaaattacatcgcacgtatgcgcgaaaaagttggtcatgaaggcatgatttttaacacggtattcggtgtgttatggcagacggatcgttcggcaatcttattagagaaacgttctgatattcaaaaaggctggggctttccaggtggctatatcgaatacggtgaaacgccacaggaagcgattgtacgcgaattcaaagaagaaacgggacttgatgtgcgtgtgaagcgtttgctcggtgtatcgtctgaaatcgtcagtgagaaccgctggggtgatgcgcaagaaacgattgcaatgggctttgaagttgaagcggtcggtggcacgctgcgtgaagatggtgaggaaacgttggttgtttcatacgtaccggtgcgcccagaacccgagatgtttgtgccacaggcgcaaaaaactgttcatcaagtgattaatgataatgaagcttccgaggctgtttggctacgtgaagactagacgagagtcgcactcaaattgggtgggactttttaattacaaaattaattagttagtttgtgttgacttaacctaactaacggtttatacttctttttcgttaggttggttgttttaaaactaactaattaactaatgactatttgaggtaaaaataaaatgacagatgaaacacaagatttgatggaatcattcagccgtttgatgcactcgcgcttctttatggcagcgatgtcaatgaatatgcgtactaagcgcggtagtgataaggaattgggacgtggccgtttgcgcttgttgtctttgttgaataaggaagacggtctaacgaatgcggaaatcgcagaaaagttggatattcgtcctagctcagtgagtgcgcaagtgacgagcttggttgaaacggggatgatcgaacgccgtgcctctgagaacgatggccgtgtttcacttattttcattacagatgccggtaaggagacgctagctggtttgcataacggtaatgacgagatgagtgaacgtgctttctcagtgctcactgaagccgagcaggcgcagttaaaggacatgttgcgtcgcatcgcagccaataccgaggacattgaaatggatcctgagatgctccgcaatgcgtttggaccattcgccgagcgtttccaaaacatggacttcactgaccgccgtgaaatgcgcaaggagatgcacaagatgcaccacgacttgcacaagggcttcaagggctggttctaaccgtcaaaagataagagataagaggcagagagatggatcgtggacaaagcgttgaaacggaagcatttcaacgaccagcaaagtttgatatgaaggcatttatgcgcttaattcgtcaaacaaaaccagcctactggcaactaggattggggctaggattaggcgttattgcaacgggtattcagttggccgtgccacattttgcgggtgatttaattaacggttttggtaagtcgattgataaaacattgctcgtcagtgtaattggtatgtttatcctgagcacggtgattagcgccttgtcaggaactgttttgggaatctttggcaaaacgtggttagtcgtttgcgtaataccttgtgggataaactaattcgtttgcgcgtcgcatattttgatgaaaccaaagcgggcgaaatgacgtcacgtttgagtaatgattcaacgcaaattaaagacttgttggcaaactcatttcctcgtatgattacgtctttgctaacggtggtgggtgcgttgacgttgatggtcttgaaggactggcgcatgacggcgattatggcattggcaatcccattggtgatgttggtgatgttgccagtgatgcgtcaatcacacaaggttggtcgtgatcgtcagaattcattggctgactttaatggcgcggctggtgaaacgttaagtgaaattcgtttggtaaagtcatctaatgcggaaccgtttgaaactgaaaagggtcacacgacgattcaatctttgtataagattggtttgcgtgaagctgtgtatgattcagttgcgggtccgttaatgacggcggttatgatgggattatttgttggtgtattggcctacggtgcgcaccgtgtgtcacaaggtacaatgacgatgggaacgatgttctcattcttgatgtatcttttccaattgcttggtccatcagcaactctcggtcaatttttctcagatttggctaaggcgagcggttcaacggaacgcgtccaagcgttgttggctgagccagaagaagatttgacgtctggtgtcgacgtcgacgttgaaggacaaacattggcgatgagccatgttgatttcgcttatgatgacagcaagaagattttgagcgatgtgtcgtttgaggcccagcctaatacagttgtggcgttcgctggtccttcaggtggtggtaagtcaaccatctttagtttgctcgagcgttactacacgccaacggccggtgagatcatgattggtaatcatgatgtgtcagatgtgaatttggctaattggcgtgaacaaattgggtttgttagccaagattcagcgattatggccggaacaattcgccacaatttgacgtatggattaacgggtgaatactcggatgatgatttgtggcgcgtgcttggattagcgtttgcagaaaagttcgtgcgcgacatgccagcaggtttggatactgaagttggcgaacgtggtgtgaaggtgtctggtggacagcgtcaacgattggcaattgcacgtgcatttttgcgtgatccaaagattttgatgttggatgaagcgactgccagtttggattcagagtctgaggcaatggtgcagaaggcgttggagtctttgatgaagggacgaacaacgttggtcattgcgcaccgtttgagtacgattgtggatgccgataagatttactttatcgaacaaggtacggtaagcggcgctggtacgcacaaggaattggtggctaatcacgagttgtaccgtgagtacgttgatacacaattcaatcaagattaatatgtttttgcaggcgagtgtagataattacactcgctttttgtttcatgtggaacaaaattagttaacctgggtatcttttattgtggacgactttccccttttgctcttgaataaaagtaagtaacgtttataataagaactcgtgtgagatttatatttgtgagaggtttgaataatgcaagaggtgaagtatgtgatgtcagcaaaggcgtcagctattgccgctatcgtaacgattgctgtattcgcagcattgatgttgctatttagcgctgagggcaacgcctcaacgtttgaagttgagctagatgttgttctagcctttgttgctttgttagtcgtaggtagcgtttctgtcgctttgcgtcttaagaagtaatcatatatcactgggcggttggtgagagagccacccagcgagtaagaaatcattcaattgaatcattccttacagacaaaaacgcccctaacttttcagttaggggcgttttgttatgcataattagaagtttgtcttgtcggcgtcagtgtgagtaccagcgacaccttcaagcttatccaacgttgccatgtcttcagcagacaactcgaagtcaaagagttgaccgttttcaacgatacgctccttgtgcgttgactttggcaaaggcaagaagccgtgttgcaatgaccagcgcaatgcaacttgggcaactgacttgttgtacttgtcggcaacttcttgaattgcagcgaccgtcaacatcttacccgttcccaatggtgagtaagcttcagtcaaaacgttgtgctcgttgttgaaggcaacgatttcagcttccatgtctgaagggttaacgaacaattggttaaccataggcgtaaccttagccgtcttcaacaattcctcaaagtgagatacttggaagtttgagattccaattgcacgtaccttaccagcttcgtaggcttcttccatcgcgcgccaagtctcagcgttagcttcggcccagttttcgcggttagcctttgggtttggccagtgaatcaagtacaagtccaagtattccaagtccaagcgcttcaacgtgtcttccaaggcttgcttagctgactcgtatccgtgcatgtcgttccacaactttgacgttacgaagatgtcttcgcgggcaatgcctgaatccttcaaagcacgtccgattgattcttcgttaccgtaagcagcggccgtatcgatgtgacggtagccggcagccaaagcatctaacgtgctttggtaggccacatcaccatcaggcgtttgccaagttccaaatcccacaacggggatcttaacaccgtttgaaagtgtgtaagtatcagtcaatgatgaaatagtcattaaatttcacactcctattaaattgatgaggtgcatcgacgtgtaacgttactaaataaaaataagttacacaactactccttaatgataacaaaaatattgagaagtttaaaaaattaggcacttttttaagcttcagctataataaagcagactaggagtgtcggaggttttgacctccgacgcgaccaagtcgcccttatcaggtgcgttgttggtcttacgcctgactaaagtcaggggttttagaccaacagctgctgtgataaaccagaacggaggtgaacgccatggcgaaagtgacgacagagtccatttttgatgccgcacgagcagttctcgacgaaaagggttttgaaaagtcacgtttagctgacgttgcccgaaagttggaaattacgccggcggctttatacaagcattttgcaaataaagaagcgctttttgaagcgatgaatacggcttggttagagcaggttgatggtccggtctgggaagcgaatgttcgcgccccggaagaagaacgtgtcacagccttgcacgattggttgtggttgttggcatcacgtcgacgcgaaggatttagccgtgagcctgaaatgatggctttttacgaagaacaattggctaaccgtgatgtgctgcttgatccgcgcttgcaggattttgcactggctgttgaaaacatcatggcctgggatacattccgaaatcagcgtggcatgaccattatgcagacgtttacatatttctatcacccgttttttgcggataagtgggatgataatttgtttaaaacgctgttcgaaacaacgtggcaagaaatgttgccggttgtggagcaaggaatcgtcttaaatgaagaagaaaattgatcgatcagcgttggtgacgggtgcaccaacgctttttggtttacaatgtcattaggtttaatgtggggggatatctatgacgactttagaattgaaacatgttaattattcgattgacgaccggactattttgaaagacttaaatttgaagcttgcatccggtgattgggtgacggtagtgggaccgtcaggaacaggtaaaagtacactattgaaaattattgctggcctccaagatgccagtgatggtgatgtcgtgctggatgataccagcacactgaccatgccaattggaacggtgcgccaacaaatctcatacgctacgcagtcggctcaattatttggtgagacggttcgtgacaacttggattttccgtttttggtacgtcaagaaacggtaaatgaagtcacccaacgcgagggtttggtgaagatgggactgccagagaactatcttgataaggcggtttcagaattatcaggcggtgaacgccagcgaattggggtccttcgtaatttgctatttccaccaaaggttttgttgttagatgaaatttcgacagggttagacagcgaaaccaagacggcgatttggcaagctattcacgccttgcatgaccgtgagaacaatattgtcttgtcggtcacgcacgatgagcaagagattgctgaagcacaaactgtactgacgttgcacgaaggcgagggggtattgacgcatgaatagtcagattaatgttagcaattggtcgctcgcccttgcgtttgtattggttgttatctcattgggaattagttatcggcaaaaattagggcttgaaaaagatacgattatttcggttgcccgcgcgattattcaactgattattgttggatacctattgaagtttatctttaacttggataattggttggtcacgattgtgatgcaattgttcattgtttataacgctgcacgcaatggtaagaagcgtagccaaggaattccaggggctttctatatctcttggtggggattgcttctatcaacgacggtgacaatgagcattttggttttgacgggtgtcttgaagtttgaaccttatcaaatgattccagttacgggtatggtggccggaaattcaatgaccgctgtgggacttgtttatcgcagtttgaaccaacagttccgtgatcaacagggacaagtttttgagcgtttggcgcttggcggttcacctaagctggcggctagcagcatcgttcatgaagctattcgtactggtatgcaaccaacgattgatacggttcgcacttacggattggtgtcattgccaggtatgatgtctggtttgattatggcgggtgttgatccaattcatgccattaagtatcaaattatggttgtgttcatgttgctttcagcgaccggtatttcatcggtctttgctagttttatggcctaccgtaagttctttaatgaacgttggcaactacaattgccagttaagaagtaagaaaaaagaccttcgagaaaaaatctcgaaggtctttttgtttcacgtgaaacacgtggttaatcttcaaatttaaaggcgtttaggaagtgcttgatacgatcggttggctcgctgaagaattcagctggtgtaccgtcaaagacaatctcaccgtcttccaagaacagcatgcgatcagcagcttcacgcgcaaattccatgttgtgtgtcacgataatcattgattgatcatcctcggccaaaccattcaagacacgcaaaacttgtgcttccaattcagggtccaaggcagaggttggctcgtcaagcaataggtaatcaggtgacatggccaaagcacgggcaatggcaacacgttgcgtttgaccaccagatagttggtaagggtaacgatcagccgtgttatccaaattaacagcttgtagcaattcgtgggccttagcaattgcctcagctttattgtgcttcaaaacgtgaacaggggcctcgatgatgttacccaaaattgttagatgatcgaacatacgtggttgttggaaaaccataccagtcttacgacggacccaaagtagtgtttcagttgtgattggttggctcaaatcaatcgtacgatcgtccaacgtgtacaaacctgaatcagggtgctccaacaagttaagtgagcgaagcaacgttgacttacctgaaccagaaggtccgacgataaccgtcgtctcatgtggattgaacgtgacgttgatatcctttagtgcgtggtgctcagcgtattgcttatcaatgtgttctaacttcaacataataaattacccctgtacctttacgaaacgatcagcccatcgttggatgtagcgttgtggaatagacaaaattgaaacgaatagcgcgtaaattgcagcaactagcaagtacatttgcaatggttcaaagttggctgctgccaattgttgtgaaaggtagaacatctcgacgatcgtaacaacagatgccaatgacgtatccttaaccaaagaaatgaatgagtttgccaacgttggaattgaaatgcgagcagcttgtggcaagatgatacgcaagaaaatttgtgaatcagtcataccaagtgctgcaccagcttcacgttgcgtatcaggaattgatgagatagctgcacggattgcttctgaagcgtatgcagctgtgttcaatgacaaaacccaaatagcggctgcccatcctgaaggagatagccagctgatacccagcttaggcaatccatagaagaccacgaacaattggaccaacattggggttgaacggaacaaccaaacgtagaaccataggatgaacttcaaaatgcgccaaccaatggatttgataccagttgcatgtgggacatatgaacgcagcatcgcaacgattgcggcaatgatgacggcaataacaaacgagataagtgctagaggcacagtgtacttgatacccgccataatcaattgtggggcatacttggcaataaattcgaacatgaagatttcctttctgaggatgagcgcaaaaaagagcgcgccgacagtttctgtgtgacacaggaaaggcctagcgcgctcttcttaacggttcatcggaatgataagttcaccaaaacgacctaccgcgagtagcgcgataggctgatgcaagcaacagtaatttgtgtgttgatcgtcatcatggttaactttccttccgtcttttttgatttgtaatagctgtgtttcattctagagacatcactgactaaatgcaagcgttttaggataaaatttctcgatgctgaattaaataaacattaaaaaggtatttgacaaccatggcaaagtgggtttatgctatgcaacatactttttgaaagggcgtaagataattatgcaaaagcacagctttaatggaattaagctagtcgcagcggtatttgccgcaggaacattgttgagcgccggggtgtgtaaacgctaatgcggattctactaagaacctcggccttctacacaaggatcaactaactgttggtttggagggtacgtatgcaccatattcataccgtaccgattcaggtgatctaacaggaattgatgtggatatggccaaggaaattggtaagaagatggggattaaggtcgtctttgtaccaacgaagtgggattcactggttgcaggtctacaagaccacaaatacgatattatcttgaatgatatggctgtgtcgccagcacgtatgaaggtattccgctatggtgcgaagtacatttatactgggggagttgtcgtcactaagaaggattcaggtatcaagcaagttactgatattaagggcaagaagactgctcagtcagcaattggtaactatgtgaagtacgccgagaagctaggatctacaaatgttgctgtaccaggatttgctgaagcggttgccacggttgaaaacgggcatgcagacgcaacattgaatgatgcagcggcctggggagtttacaagaaggcgcaccctgatactgatttgattgcgattccttcaccatcaaagtacatgcctgtaactggggcggcacctatgatgaataagaaggccgttgcccttgataaggccgttacgaaggctgaacacgagcttcgtaaggatggtgtcatgaagaaaatttcagaaaagtacttggatgctgactacagcaatccagccaagtaagatttagcatttgcaatttagggatcgttttggttattatttgaaagtaaccggaacgattcctttttcgtttgcgttaacaaatagacgcgcatatactcactcaacagaataagagttgaggaagtgaaacgatatgatggtttcgtcaataaattatcgtaagcgctactgggttatgcgtataaacattgcgttaagcgtaatgtttgttgcgtttagcttgggatcaacactgatgataaatacagctatgtaggcgaggatataaaaatgaacaagattatgaagacgtccgttgcattggttgcagcaggtatgattggtggggttgttgcatcagcaacgactgtttcagcagcatcatataagagcgaattgaagactaagggcaagttgactgttggtttggaaggtacgtacgcacctttctcataccgtagtgattcaggtaagttgactggattcgaagttgaattggttaaggctgttgctaagaagatgaggttgaagcctgtgtttgtacaaaccaagtttgactcattggtagccggtttggatgctaagaagtacgacgttgtgtttaacaacatgtcaatcacaccagaacgtaagaaggcttacgcatttgcgcaagaatacttgttcactgagtcagtgatgattacgaagaagggttcaaagattaaggattacagcgacttgaagggtaagaaggcggcacaaacgtcatcatctgactttggtcaagctgctactaaggctggggcaacgattgtgtcagcgcctggttttgcagaagctttggacttggttgattcaggtaaggctgatgtgacgttgaactcacaagattcatggggcgtttacaagaaggcccacccaaagacggacttgcaagctaaggtaacgaaggctttgggcgagacgaccgccgcacctatgctcgacaagaaggataagaagttggccgctcaaattacaaaggcagagaagtctttgcaaaaggatggcacgatgaagaagttgtcagtgaagtacttcggttctgatttgaccactgagaagaagtaaaacgctataatagtcccatggataccagtatccatgggacttttttgataggggaaaggctatggtagaagcaaaaagcatcgtggtgacagggcgtgttcaaggggtcggctttcgttatttcacgaagatattggctgatcgcttgggtgttacaggtgtggtttggaatgcctcggacggctccgttcgaatcgaagcgcagggtgatgagatggcaatgaaggacttcgtgaatggggtgagtgtgtcaccttcaccgtatggtcgggttgattcggtcacatctgaggcgattactgtatcgccagaacgacgaatttttaaggcgatttagtgacgtataccaatctatgtttttaaattgagaatcgaccattttattagttgaaatttagcagttgagcttgacgttgatccaccacttttgtggtgtggattgacgtcttttttgtcgcttttttgtatttactggggtgttgttttgatggctgattggggtggattttggggtgcggtttgtttattttttgatggggatgagttgcgtttctttagattgacggttgcaaatgtcggtgattttggacgttgggtaccgtcggaatttgtcgtcctgacgattcctaatatgcaaccgaatgcataaattacatacatgtttttgcatataaatgcatactggatatgcatgtaaaaacgccgtcttggtggtgtaaaaacgtgaaaatcctttacatttttaactgaacgccccgttcaacagatgtaacgtgtaacacgtgtaaactctgcctttagcgccttcgtttggcgaaattgcattatacaatgaagttattaagacgtcatttcccctaccccacccctgtggataactcaatatttcttgcttacagcgggtacttcgggtaagctgaattgtcggaaaaactttttggaggtttttgagaatgactttgaaaacatggttgaaattcgttgaaattcaatctttggttgcaagcgtattgccgttggtgttgggtaacttatacgcggcgattacttatcaacatatgaatgcagtgctagcgattgtgtttgtgatcgtcgcatttgccttgcagatggcagtgaatgtttggaacaatttgcaggactttaagtcggccacaagtgaggaatggaagaacggtgtgaacaacattgttgggtcagggggcattacgccacgtcaaggatggacgacgctgattgcgttggttttgattgttgccgtcgggggtctctggttggtttcacagacgggtataccattgttggtgatgggcttaattggcttcgttgttgcatactggtatgcgggtacgccgttgccattgtcacgtacgccttttggtgaattggcatctggtttgacgatgggatatttgattttcctaagtgcaacctacgtaaacgttgccccaacgtttacgactgaattggtgttacacgctatcgttgcatcagccatttcttggttcgcaattggtgacatcatgttggccaataacatcggtgactacgaggaagacttggctgagaatcgtcacacattggtttggtacctcggcaaggaacgagccgttaaggtgttcggctggatttatttggctggctatatcgtgttgattttggcagttattttgcgtattttgccatggccggcattgattacgttggtctcattcccaatcgttatgaagaatacgaaagcctttcaagcgaacccaattaagccaaactttccgcaagcaattaagaatgcggtggtcatctcattgaccttggcaattggtttggttgttgcgctatttatttaatattttgaacaatgcgaaaaagctgcccgctccaatttgagagcgggcagctttttgtgttaatccaattcaacaccagggttatcaatcagcaacaaggcaatcatgacgaagatgatgtttgagtggtttgaataagcgatgtagtaaggttgccaatcactagcaaacttacgcttatagtgacgcaaaccttcgaatgaataaatcgcagaaccaaattggaaaatgaggttggcgatacgttcgcggatgaaactgtgttggtacaagccaacgttggctagcggtgacatcccaaggttgaatgtttgataaccggcatcgcgagcatattcgaaagtcttaacgaacagtacgtccatcgtgccgtttggcgattccttcgtgaaacgcatgagatcgacggtcatttgattttccgtgtgtgacgtaaccaaggttgcgaaggcgacgatatggccgtcaggagcctttaaaacgccaatgccgtcacgttggagataatgatcatcgaagaaccccaatgaataacctttttcttcacggccgttcaaccattcgtttgaaatagtgcgcaactcgttcattagcacagggccgaatggtggttgcaaaacttcatattcaaagccggcggctgctgcctggttgatttcactacggatattcgcgaatttcttaccggccgttttgaagtttacggtatcaacgcgagcttcttcaccgagcttcatgaagttataaccgaactcgtgggcgatcatggcaatttgttctgagacctcatagaaaattggcatgtaaccaaggcggtcggcttcggtgatgaaggcgctcatagcagctttgaagtcattcgcgttaccaaatggatcgctcatgacggcggctttgttgttgatgagacggaattgaatagcgacggaatcttcagcaccttcctcaggttggtagtagaagagacgcttgtcgcctaagaaaatcaagtttgtgtagtggttatcgccgattgcgagcaccttttcaacacgttcttcatcaagcgcttcaccgagtaattcgtgcttgccttgtaagtaggcgataaagcccaataccccaagactcacagcgacgattgttaggaagccaatcacccaccaatggaatgatggtaacaacaacagccctgtagaacggatgtggaagtgcgctgacacaactggcaagttggccagtccaatcaatagataagcgataaacaaaatactgtaaatggcgccgtcgattagacgagattcccaactgtatacaagttgctcacgtgttaaacgtggcttgatgaataatgtggctaggaataaggcacccaccagaatcactggtgtgatgtaactgcgtgaaataaagacgtagataaatgtgatggctagcaaaattagcgtcggcacgtaggcgcgctttactttgctagcgataccacgtccagccatgattagcatgaaccctaagaagatgttgggcacctgtgttaggaagttgctcgtccaagggctgaaacgttgtaagaatgtgattgattccagtgtgccagggagcgcaccaaccaaaatcatcgcgatacccatcaagtagagtaagacggcatcgactttttgaatgattgatccggcgatggctcttggtacaccacggaatgacgtattcaaattaactagggcgctactgatggctgcaattacggcgatgatgccgggaattgcggtgtatgccaaacggtagaacataatccataggaatgcgactgctgagtcaatgccaagatgttgtagtccgaagaaaatgaagatatcgaatgtgccgtatccaccaggaactagcgtaatgaggccgatgatgcgagcggcaataaataatggcacgagctcaagtaaaggcgttggcaggtgcatcacggcgccgaatgctaggaatgcaacggtgccaccaagccattcaactaatgaagcaccgactgtctgtgtgaatctgcgcttcgtaactgggaatgcaagtgatttccaattgcgaattgtgaccgcaacgccaatgaatggtagcaacataccaactaacaaaataaatgagtaatcagcaacgggtgctttgggccagaaaagaagcgtcgcaccgaaactcaacaagctggcgatgcccaagccgaatgtaccttgccaccagtgctggcggattgtggctgagtcttgaatggaacggctgttaaacacgcggccgcgtaaccagctcatgaccacatcaccaataccgaatgcattgtttaagttggcgattgtccaactttcaaaccaaaacttgcgacctttaggtgcgttatccgcatcgttatcctggaaaattttgcgtagaacccagtctgacaagacgccggtgctagcggcgactaaaccaatcaaaaagatgctgatagttaggctgattggcaattctgccaaaatggcgaggatgctttcgggcggaatgtgtttgaccaatgcccccagttcgaacaatgcgacgaatgcgacaccgatgatgaagattcgcctgaaatttagaaaactagatttcataattaatgctccttaagaaattgacgcacgatgtttgagaaaaccaacggcgaaaattgaatgaataaatgcgttttgaatggtgcgacgtagagtgtgccattacccaaagcgtgtgcgatgtttagcgaatggcgtcgcttgataaagtcgaattgcccaactaaaacaagagttggcgccataacagcctgcaaatctcgcttggaaatgccgggtgttttaaacatcaacccagtctgctgccagcgcgcttcgaagaatggatggatatttctcagtttccccagtaaccattcaacccagctggctatcaagacgattggcttggttaatccgttgatggttaggttgggcgcgtttaagactaatgcgtgaacgtgcgcaggattatccagcgtataacgtaaagctaagttggcgccatcgctatagcctaagatgctccatgtcgggatgttaaccgcgacacgcaattcttccaaatctgatgctagtagctggtaattgagttgtagctggttattggttgattgaccgtgaccacgcgcatcttgcgtaatgacatagaagtcatgcgcgaagagggggaggtaggccttaaagtcctgttgtgatccgttgttaccatgtaataacagcaaggcgggttttgtaggtgaaccatatgtttgataatcaatttggctaccatctttagtatgcaatttcatataaaatgcctcgatatgttaatacttattattttacacaaaaagcctgtggataacttgtggaaagtttgttcgcatgacaaatgtcacgcgcaatcacttgttaggttaaacttgattaacaagtgaagaaaatcacaacgcccataaacgggcatttgtggcgcattttggtataataaaattcattaggttgcctacttttgcgttggcaaccgcggggaaactatcaaaaatgaaaagaggtaggcgcgtgttacagcaattgagacaatcacgactcttgtattggacagtggaattattggctgctgccctcttgatcttggttgtaacgcagttgagtttcatactcgaaccgattggtaaatttatcggggcggtctttgtgccgctaattgtatctgggttcttctattatttgttgaatccgattgttgggttacttcaaaaaattcacgttggcaaatttcgcctaaaccgtgttgcgtcaattgcaattgtgatggtgttattaatcgcactgattgttgccgcttttatggccttggtgccagcattagccacacaacttggtaagctggttgataatgcaccaggattgattaagacatcgcaaagttggattgcgcagctaagcgaaacggactgggtaaaagacattggcgtgaatgctaatttgcaggatttgcaggctcaagttcaaaagtacggtgaaacgttaatctctggtactgcaagtagtttgagtacgttgattgggacgattaccagtgtaacaatcacggcggttaccgtcccggttatgaccatttatatgttgaatgacggacaaaagctggtaccgttcttgcaaaaaatcttccctggccgaaatgagggtcgtgtggctgagattttgggtcgtttaaacaagacgattgcgcaatatattagcggacaagccattgagatgattttcgttggtgttgcgacgacgattggttactttattattggtcagaattacgcactgctacttggtatctttgctggtctaacaaacttgattccgtatgttggaccatacatcgggttggtgccggccatctttgtggctttcacccaagatgtttggcaagttgtctgggttgttgtagtggtgttgattgtgcaacaaattgatagtaacttaatctatccacgtattatgggagcatcgctaaacattcacccgttgacgatcattatcttgttgttggcagcaggaaatattgccggtattgctggtatgattttggccgtgccattctatgcggttgtgcgaacggttatcgtttacgcttggcaactatggcaaatcgaaaaacaacaacgaacagaatcctaaaaaatggcgctacctcgcaagaagtagcgccatttttctatttaacgtgagttacgtagtagtcagcccaaacccgcattgcttcgtgaacgtcttgtagctgttgcccaacgtcagtcaatgaatattcaacacggggtggcgcctcgggataaaccttgcgagttacaattttgttttcttccagccatttcaaattgctagtcagcactttttgcgtgatgcccagcttcttttgcaattcgccaaagcggagcgtcccgtcctctaataagaggttaacgatgtctggacgccaacgattgcgatgcagttcgttaagggttacgagtttctcagcaatttctggtgtcatgtcgatactaaacgtcatcgggtgtctccttgtttttttctgtgaagctaatgtatcacacaatagtttctttagggaaactatgccactttaaagtgcctacttatgcaatttatccgcgtgcgctatattataggcatagacaagaacgattttgaaaaagtacttggaggtacaaaactatgacccatacagatattgcaaaagcattggttggtacatttgtttcaggtgatatcgcggttgctgaggcaagcgcgttgcctacctacaagcaacacaatttgaactttggggatggccgagatgcgtttattggcgcggttaagggcttgcaagaagcacccgtgaagaccacgttggaaacggttcgttcatttgaagatggcgactttgttgttttgcaaaacgtggtgaacttcgccggttcgggtgatcaagttgcctttgatgttttccgttttgaaggtgacaagattgcggaacactgggataacgtgaccaacgtggtggcaccaaacccatcaggtcacacgcaattcgatggtgaaacagccgtgacggacttggacaagactgacgaaaacaagcaattggtatcagacttcgttcgcgacgttttgcgtggtgaaaacccagaaaagctcccagaatacattgctggtgaggactacatccaacacaatacagatattgctgatggtttgacgggacttacgacggcctttgcagcgatggctgaacaaggcgttgccatggtttatgacaaggtattcaaggttttgggccaaggaaactttgtcttggtgatgggggatggtgaatttgccggtaaggcagtgacattctacgatctattccgtgttgctgacggcaagattgcggaacactgggacattattgaagaaattccggcccgagacaagtgggctaacgacaacggtaagttttaaatagtacaaaaaagctggcaatcttcatgattgccagctttttaattaccgtattttttggattggattgtatatgttttaaatagacacggtaatgtttttgttagaacttgtcagctgccgtgaaacgaccgtgaatgtgagtaggagcttccaactcatcatacaaagccttggccagcgtaccagtcgtaacacgtgattcctcacgtgcgttgaagatcaaagcgtcgtctgacttcaagtatgttggcgttgcaggacctggcataaaggcttgttgtggtgaaattgccatccaggcgaaatcatcaaccgtttgcaagtacttgtattcgtttgcttgctcgattgctgcttcaatccaaggtgcttgtccacgcatcaaacctagacgatcagccattactgagccatcaggcatttgcaaagttgaagaaccaacaatgaagacgacgataggggcgtcagtgccagccaattggtcgtgtagatattcggcgaaacgaacgtgatcactagcgcgagtgaagttcgaagcgacgatgataacatcaaattgtgttaggtcttcgcgcgtcaattcgaagttttgacgttcgaaagaagggatttcattaccaaacatacgcgtcaccttgccggctgaacgtgtgattgcagtaacttggtgcctacgttggtaaccttcgataacaaaggcagaaccggccattccggttgccccgataattccaatcttcatgtgcatactccagtctgttttttcaagccttataatagtcgcttttataaaagtggacaaataaaaagggtcaaaaaagatttcgctgttaaagtcgtctcattcatttataataattcttaaataccgcagaagggtagatgagaaatatggcagaaaaccagttggaaatcggcaagctagttgctgaaaatgatttatatcacgaattgctgggtggtcgtttcggcatcgaaattgaagagcatcgcgttacggaagagggacgcttgagccgtcgtgtgtatccggatacattaggtccacgggccacgcacccctatttacagacggattatagtgaaacgcaatcagaaattgttactgagccagctacgtcatttgagatggcacgcgacttgttgttgcaattacaatgggttttgcgtgatcacatggccgaaaacgaaacgatttggccattgagtatgccaccacgtttgacgcctgacgatttgcagtgggtcgatgaaacgtttgatcgaccatggattagtgaatatcgcgattggttaacggataaatatgggtcaacccacgaaattatcaccggacttcatttaaattattcattgccagaatcgttgcttgaaaagttgtttgcgcttagcgatgaaactgactatgtgacgtataagaatcgcgtgtatttcaagttggcacaagccatttcagctaatcggtggttgtttgtgtacttgtttggggcaacgccatttagtttgaattcaactgattcacgtttgcctgaacttgagcacccagtacgttcgctacgaacgagtcaatttggatttgcaaatgatgcaaacatccagattaattatgcgacaaatttggcagatcatttggaccaaatcgatcagcatatccaggcaggggatttatattcaaaccacgaattctatggcacggttcgatttaaggggccggagacaaaagaagcgatggttacagaaggtgttcattacttagaattgcgtattttggatgctgacccctttgacccggcgggcatttctgaaaatgcgctgaacatcattcacttggtaattatttacttgttacttcaagatgaggtctattcggcagatgatttggtgcacgccgatgagctagcaaatgaaatcgcaatgcagtcaccgacggataaattgcctaatcaaaaagaggcaatggccttaatgggggaagtgtcaaagcttgccgatcattttgttatgcgctttaacgatggcctatcactgattgcagaacgcatcctaacaccaagcaagacgccagctgctaaaattgtggcgctggctaaaacgccagatgagctacaagcgtgggcgacgaaggtgggaaatgaacgtggtgatttgttccacgtgaaacatgacgaacagtttgaggatttgtttggtcgtggtgaattagctagtgtcattaagcaggcgtatgagttaggtgtacgtgttaaagagcgtacccgcgatactgtgacgctatcagtcggtgaccatgtcgaagttttgcacgagtccaaggacctgacggaattgttcccagaaatcttaccggcctaatttactgactaaaaggaagtaaagtgttacaatagctttcgtgatatcgagaggacggtcgaaacattgggctctctcgtcaaaatgaaggaggcaactaatggcaaaagaacacccttttgattttaagaagtgggacgcctttttggcagaaattgaaggcaaggaaattccttgggtaatgggggctgtcgcagatggacacccacaatacgacgaacgcatgattgagcttgctaaggcttttgagtggtcagattactttgatcgcaacttcgatcgtacgttgaagcaaaagggacaccaagagttgcctgaagaagaagtggatgaaatttcacgtaatagctcagacttccgcgacttgcgcgctgtgacatctgttgtcatttacggtgagcgtcgcttggaaggtatgtgggcagctatgactgagaagggtatcttgcgtcgcttgttgaagcgtttgaacgacatgacgccggacgatttcccaggtccaaattactaaaatcaattaacggctaggctcaattgaacctagccgtttttgtttgcgaaaaaagaaatattagttgccgtaagtcggcgaaatcttgaaaaatgagtgaattcttatatactagaaagagtgttgcaactttgcgacagcgttattggaaaagaaaattaaataaaaagtcagaaagagagtgttaactatggcacagcaagaagcttctaatcagaagctagaacgtggactatcaagtcgccacgttgagatgattgcgcttggtggaacaatcggaactggactgtttttgggtgctggtcactcaattagtacagcagggccagctattctgctaatctacatcatcactggattgttcatgttctggatgatgcgcgcattgggagaattgttgcttactgatcctgataagccaacttttgtcggattcgttgagaagtacctaggcaaaaaggcaggcttcgtcatcggttggacgtactggattggctggattacgattgcgatggctgaattgacggccgttggaacatatatgaagttctggtttccatcagttccagtgtggatttgggaaatcattttcttggcagccctttacggaattaacatcattgccgtttctgcctttggtgaaacggaattctggttctcaatgattaaaatcgttgctatcttggcaatgattgtgactggaattattatgattgtgatgcacacgaagacgtcagccggggtaacgagcctatcaaacctatggcaacacggcgtggtggcacaccaaggacatcaaattttggcagcgttccaaatggtcttcttcgcctttttgggaattgagttcgtcggtatgacggctgctgaaacaaaagatccattgaagacgattccgaagtcaattaattcaattattatccgaattttgatcttctatgttggtgcattgattgccatcatgagtattcaaccatggacgaattacaatgcaaacgaatcaccattcgtgcaagtgtttgccggaattggtatttcagctgcggctggaattattaacttcgttgtgttgactgccgctgcgtcatcattgaatagttcattatttacaactggtcgtatgcttttctcattgtctaatggaaagggctacgctggtaagttgaaccgtcgttacattccacgtaacgccatcaacatttcaacgattttgattgctttggcagctgttgtgaatgttttgttcccatcgaacgcgtttgatttggtgacatcggttgcctcggccgctttcgtggttatctatggcgtgcttgtgtttgcgcacttgcgttaccgtcaatcagatgacttcaagaacggtgaacaacacttcaagatgcctggagcgccatttacggattacctaacgatggctttcctagcaggtatcttcttgattttgctatttacgaagtcaacgatgccaacaacggtcttggctattatctggtttatcatcatgattgcccttagtcgccgagttaaagaataaaatagtgtatgataaaggtggatgcagatatgcattcaccttttttatttgtctaggaaagtgagcgaaacacatggcagaaaagtttattgagcgagactatcaaaaggtcccagccgaaaccgactacattaagcaacaatggcacgatgtggcctacatggatggtgaccgtcacagcatggatatttacctaccaaacgacggtcaaggacctttcccagtcatcgtcgatatctacggtggtggcttgatctttggtgataagagttcacacaagctagaaccagctttgcgtatgttggataagggctatgctgtcgtgagcgtggattactcattgattcatcaaaaggatttcccattccaaatttacgagattaaggctgcactacgtttcttgcgtgctcacgctgatgagtatcaattggatatggatcgcgttgctttgatgggtgagtcttcaggggcacacttggctgtgatgactggtgtatcagcgtcagttgatgcgttgcaaaatccatttatgggtgacaataacaatcaaccggaaatagtaaatgcgattatcgcgatgtatggaccatacgcttttgatcaatttgtttcacaatttgaagagagtggtgtgacgccaaagtacgctgaaacaggtacagcggaatcattcgaaggtcaaatgtttaacaagcaagcgcctaaggatgtcccacaacgcgttaagaactacaacccagaaatgtactttaatgatcaaatgccacctattttggcatttgcaggaacggccgatgctgtggtaccttatcaacagacagttaatatgattgacgcggctcgtcagtatgttcctgaagaaaaggcagtgttgcatttggttgaaggaactggacacggacctgcgtcatacatgacgccagagttcaccgatgagaagattgccttcttggagaagtggctctgatttagggggcaaccatgtttggtgcgtttggtaagtcgttttttagggcgacaccacaacaattatttgtacaattaattattgatacggtttggtttttgattttccgaccaactgacccaacgatgaaatggatttttattgccattttgccagcagttgatttgctatcagcggtggttagtttttggaattacgtcaaggacaatcgaccacaaaattaaaacgagcgaatgtttcatgtggaacattcgctcgtttttgtttgccaatcaagcaaatgttttgacccggcgacgcgataactgcgatactgtaagaaaagcgaaggagataagggggatgcgtgggttaaaagtagatatcgaaaaatttcgtaaacaatttcgctttgcggacctacaaacatttattagtcgcgctaacttaaatatggttggtccaaccattacgtattacacgttgttgtcgttagtaccagtgttaatgagtattggtgcgattgccggtctggttggcatctcgtcaacggagttaattgccacgttgaaaaccaatctgcctgctaacatcatgtctattttggcaccgattattaagtcggtactgagtggtggtgttggaattttgtcattctcaattgtgacaactgtttggggagctagtgcggtattggcagtcattcgaaaagcgtttaatggtgtgcacgatgtgccggaacgcgtgagtggcatgctgacgcgtgtgtttagttttctgtggttgatggttatcttgattacggcaggaattgttatggcagcgacagcgattatgccggcgattatccaagcaattcctggtgacttgccttggttggatgagttagctaagcaaagtcgattgtttgccttgatcggattgtggttgttgatgtgtgtatttaacgttgctttgccagctaagcgtttgccatggaaggcaacgctgcttggttccggcattgaagtcgtcatcttggtattgctgaacgctggatttagctggtatgcgcaatttgcggttaagagcgtgggcttctaccagtcattaggatcgctattggttttgatggtctatctaaatttggttgggaccattatggttgttggtcagattttaatagcctggtttagcatcctctttgatcccgaagaaaaacagccagcggctgtaccgctggctgcaaaaggggtgcctgcaaaacgtcgtccggctttagctaagcgacaagttgctaagcattatcgtaagcgtacaacccgttcaagttgattgctaattaatgcgttggggtttgtgcccggctcgccatttggcaccggcaatcccaactttgcataataagtttgccattctggcaagattgaatcgtcaggcccaaaggtcatggcgatttttttgaacggatttttgactacggaaaaagctgtttcaataaattcagagcagtaaaaacctggttcactggcaatgaaagaccagttatagggttgccctaaaagggttttggctttgaaaatgaccgaattgaaatcaaatgatgttttcaaacgatacaaatcgacattaccggtttgcgcagccagaaatgaatttaggggttgccgaacggagccaagttcaggggaagcgtgtaacacaaatacgccgtcatctgctaattcaacgataccgacgtgggtgtaattgattgtttgggctttcggttgagtactttgggcaatcatttgtgaaaattgctcggtcgttgatccgacaaaaagtaaatcaccggtttgtagttctgtcatggcagcacctctagttttctggtcttacaataaaagcccgcacgcgtgcgggcttttatgattatttactttgcttcgattgcgacagcatcttcagccttcttggcttcccattgcttatcgaattcgtccaaaagtgcacgaacttcgtcagttgtgttcgtgtccatcaaagccacacgcaaatctgaggcgtaggcaaagccacgaacataaatcttgaagaagcgcttcaacttttggaagtgcattggaccgaactcagccgtgaactcatcgtataggtcaagttgcaaacgcaacaaagccaacgtttcatccaaagtgtgttcagtaggcatgatttcaaaggcaaatgggttttcgaaaacaccacggccaatcatgacaccgtcaacaccagggtgttgacgaactagttccaaaccttcttcacgagtcttgatatcaccgttgatttgcaacaacgtatcaggtgcgatttcatcacgcatcttaacgatttcatcgatgtactcgtagtgggctggaacctttgacatttccttacgcgtacgcaagtgaactgtcaaaacttgaatgtcttgttgcaacaagaatggaatccaagtacggaacgtttcgatgtcgttaaagcccaaacgagtcttaacagacactggcaaaccagctgtcttagctgcgccaataacttcctttgctgaatcgtagtgacgaatcaaatctgatccgcctccattcttgataaccgttgaatccggacaacccatgttcaaatcgatggcgttgtagccgcggtcgcgcaattcaagtgatgacttttcgaagtcttcaccacggtttccccaaatttgtacgacgggcatcttttcgctcttatcaacgtgtagacgaccttggaccgtaaactttgccttggggtgtgaaatactgcgggcgttcgtaaactctgtgtagtaaacgtcaggcgcagctgccttctcgacaacgcgacggaaaaccgtatccgtaacggcttccattggtgctagtgagaagaatggggtcttctcaacaccaggaaccttagggtgattttgtgcttcatcgacaacgccttgccagtaagctgactttgctttaaccatgtctaaatcctttctctaaacatttatattttcatttatgcggctcgatcttccgcaatccaaactgggacatttacaatattaaagggttttgcgggtcctttcaaggcgtttacatatccaaagtagacaattcctaaaaaactagtgggcagacctgaataaagccgttaaactagagtgatggggggaaagatattatgattacaattcgaccagcaacaattgctgatacaggggcaattgtccatttagaaatgacaattattgaccaaatgcaaattccaatggtggaaaagcttggtcgtgacaatattgaacaattactacatgatagtgcattagctgatgacacggcacgttactcacataagcatgcaacggtagcggaaatgagtggtgctattgtcggggtggcctttggttatccagcgaagcaagagccttatttggatgtatctttgcaacgccttctggctgaccgttttggagagttagcggagttgttcccggacaaagaaacggtgggacaagaatggtatcttgattcgatttcggtgtctgagacagcccgtggtaagggcgttggaacacagctattggctgctttgccagctgtggcgcaagcacaaggtgaacaagtcatcgggcttaatgtggatgatggcaacccaaaggcacgtgcgttgtacgaacgcgaaggatttgaaccagttagcgagctcatgattggtgagcatcattacacacatatgcaacgttcagtggaataaaccattatcttcagtcgaatagtagtacactaggaaaagtagtttattcgaggagagaagtattatggcaattaaacgtaatatggtggcaggtattttgctaactttggcggtgtctattgtggcgaaattgttatcaccatatttgccttcgctgggtggcgaggcgttagcgatgttgatgggaatcgttttgggaaacacgttgtttgcacacgaacgctggaacgccggtgtgaagtgggcagaaaagtacccaattgaaattggaattgcggtgcttggactgaatgtgacgcttaataatatggcgacattgggctggtcaggtgtgattttcatcttgctacaaatgacggcgacgattctatttgtcatgtggattggtgggcgcgtctttaaggtggcaccacaatcagcgatgttgatgggtgctggaaatgcagtctgtggatcaagtgccatcgcatcagtcgcaccagcaattggggcaagtgataatcaacgtcgcacggccgtggcaacggtttcgctagctggtgttgtcttgctgtttgttttgccagttatcgggccagagttgttgcaccataacgacatgttggtcagtgcattgattggtggaacggtgcagtcggtcggacaagtatcaggtacagcttccttggtcggtggtgacgtcgtgacgtatgcaccaatcttcaagatgttgcgcgttgtcttgctgtcagcggttgtcattttgatgtcacgttatgccacgaaggtgacgccggttgaaggtgtcgcgccgacgtcgaaggtcaaagtaccatggtttgtggtgacgtttatcgtcttggtagtcatcaattcattcgtgagtttgccacatgtgctaaccggcacagcacatgaagtcacgagtttctttggtattgtcaatttggccggcattggtctgaatttgaagtgggccacaatcaagtcttccggggcaactttcctaggatatggcttggtgacaatcattttccaagtcgtcctagcgcttggtttgatcacgttattaatgcactaaaaataagcgtcaacccgcgtggttgacgctttttgcgtaaaaatgactctaatttgtttcattctgtgaactttttgaattttctatgccttgcgtcataaacttagacttgtaataacagagaacacgttaacaagggggcaagttaattatggcagggacagtacacacacaagcatttatgatgtcattcggaaacattttggtgaagactggcgttcgacctgaagttgctggacaagttatcgcaaagttgcatgcattggaagcacaagctgtggcttacccaagcaatcgcgcttatccaaccccaaccatgtataaggtgactggccaaacgcgtggtactgctgcccaaggtttggtgatgttggccaacatcgaaaatcgttcatttaacttgtataacatttacgatgcgaacgcacgcgaattacgtcaattcgaggcgattgttggtttactacacaaccacttgcttgaagttggtgtgaagcaagtttggcacatgaattcacctgaattcacgaagctaacggcttttgcctatgaaaatgaagtgccatacaaggtggccgttgaacattatctaatggataatgtggccgcagttgatacacaatacaacggtgtgccgttgtcataataaaacaaaaaattccgtctcaactgagacggaatttttttaaggagctggcacaatcttgatgtgcaagccattagcgtcgattttgtgagtcacttgaataccgttggccgtggcgacagctggctcatctggattctcgtgaacggccatgtaggcgttgtagaattcttgtgatgaccagctcataccgtgctcaaaggcaacgaaagcgcgaccagcttcatcgttatcggcatcttcagagtcgataaaaatcatcgttgcttgatcgtccttaactagaacggttacttgaacaccgtcgtaaacatcggttacaccatgctcatcgagttgcaacttgcggtggctttccatgttgaagttgcggcgtagcttattgaattttgctaaagagcgcatgaaaaaagttccttttctttacgtattgttagtgataactttacgcctccctttaataaatgcaagcattcggtttcttgaggggttatactgttaacatagttaacgattgggagtagggtatgctttttacagaactaaaaaattacgtcgtttttgatttggaaatgaacggcagtaatcaaattatcgaaatcggtgctttaaaggtgacaaccgggcaagatattgaaaagttttccgtgattgtcaacaatccgccaatggggagcgggatggcatcatttaagttcatctcacaatcaatgggcggtgatgatggctggattacgttggaaatgattcaaaacggtatggctgaagaacgcgcgttgacacgtcttatgaaatttgtcggcgattatccggttgttggtcacgcgattgttgatggggatgtccaattgattaaggaaggtctccgctacaacgatttgggtaagtggaagaccaacggcaaggtgtttgatacacaacaaattcaccgtgcattgaatggtaatccaaatgatatttcattggccggcttagctgacgaatatgaagttgaaattggcacgcaaaagcaccgtgcgttggcagattcacgcgcaacgctagcagtctttgcggctatgcaaaaagtctgggcaaagtaaaaagacgagatgaacatcaatctgttcgtctcgtctttttgtctgcattttagtaggccaagtgacccttatcaagtggcaaaataaatgggttttggaatccagttgtatcaacgaattcaccaaacttagcaacgcgctttggatcttgcaaaaccttaatatcagcaagtgggctggcatcgaacataacgaagtcggccatcttaccaggtactagctcaccataatcatcactgatttgaagcaaatcagccgcgttggtgaatagggcacgcaaaatttgttggtttgttgcgcctgcaattgaccacaattcagcttccaaagccgtatccgcataaccgttcaatggtgaaccggcatcggttccaagcgccaaattaacgccgttctttgctgccttaccgaaagcttcgaagtgagaatcaacccacttgtaagccttatcaaccatccattgtggcaacaaaccatcaccacgcttgatgatgacgtatggtgcaaccaaagttggtgtcaaataagtgccagttgaaaggaacaagtccaacgcttcatcgtcaatgacaaaggcgtgttcaacagaatcgacgccagcgcgcaaagcttccttaacggtttgcaatgcttcagcgtgagcggcaaccttgataccacgacggtgggcaacatcaacaccagcggccatttcggcttccgtcatttgtggcatatcaggttgttcgaactgatcgaaggcgataccaccagaagccatgtacttgatggcatgggcaccttgttcgatgcgacgacgcacaccagcacggaattcttccggactagtcaatgcttcaccgatctttgaagcgtgaccaccaatggttgaaaaggcacgaccagatgccacaacaccagtaccgcgccattgaccattcaacgtcatcttttggatgccgatgtcaaagctattggctgtcgcaaggacacgcgtgtaagtgacaccagaagccaacatctcgttcaagttagcttgggcttgcatcgcaatctcaaatggctcacgcgatgccttaggaccgtatgggaacaccttgttgatgatgtgaacgtgggtattgatcataccaggtgttacaaacttgttttcaagatcgacaagttcttggccttccgcaggagctgtgccaacaccggtagatgtgatacgaccactggtcaaatcaacggtgaaccatgaattaggaataaatttttcttgcgcaacatcgtagacttgcgcattatgatacgtgcgaatcgacatgaaaccacctcatttttagactcagtttggttcagcgccaaactacttgatttctattataaacttattttttgtagaaaaacgagtatccggcttgcaatgtgtttcggtatggttacaaaaagtcagtgtcgataagttgttgacgaattgtcagggatatcatatgcttagggagtcatttaaaggggccgttgattcaaagtgaatcggcgttaatcaaagtcaaagggaatgaaattcatgcaattagttatgtcatcaacgcaagcgtttttctactttacgtttttcggttagtcatccgaatcaatcgtaaagttattttgcgttgaacactcggatgacggtaaagtatccgagtgtgtgagacatcagacgactaagcaattagtttgtatgaaactcatttagcacgtatcggatactgaattggtatctgatgcgtgctttttatttactggggcttttgtcatttgggaagaggtgtgtttatatgtcgttactaaagcggatgtttcgtaaagaatcgttagagacttatttgaagagcgatgcgcatttttcgaagtctttaacggctaaagatttaattggattaggaattggggcggttattggaactggtatttttattttgccaggtacggttgctgcaacgacagccggaccaggtgtgatttttagttttattatcgcagctgttgtgtctgggttggtggcgatggcatattctgaaacggcttcggcaatgccggtagctggatcagcttattcatacggtaatgttatctttggtgaggtaattggatggattcttggctgggcattgattttggaatatgccttgggcgtggcagctgtttcgacaggatggtcagcctactttgctaatctgatgtcgccattcttcaagttgccaaccgcgttgtcaggtgcttataatccggctgaaggaacggtcgtgaatattgtggcagttgtgatcgtcttgttaattgggctgctgttgcgagggggaatgaccgagtctaagcgcgttcaaaatgccatggtgctcttaaaaatcggtattattatattgttcattattgtcggatttttctttatcaaagctgataatttgaccccgttaattcccaagcgcatggatggtgcattcggtattcaaggtgtcttcgctggaacgtcgatggtgttcttcgcctttctagggtttgatgctttgtcagcgacggctgctgaggtgaaaaatccgaagcgtgatatgccaattgggattatcgggacattgattgtggccgctgttttgtacgggttagttgcactagttttgacgggaatggtgcattactcaaagttgaatgtcgctgatccggcagcatttgcgatgcaacaagttggccaacattgggccgccttaatcatcacaattggtgcgttgattgggatgttcacaatgatggtgacgatgctatatgcttcttcacgattgatttatgctgttggtcgtgacggtctgctcccaggtggactaggcaagttgagcaagcaaggtgagccagaacgtgcgttgggaattgcaacgattgtcgtggcgttctttggtggattcgtaccgctagagaagttggttgatttggtgaatatgggtacattgttggcgtttatggtggtgtcattgggaatcttaccattgcgtaagcgtgcggatgtgcgccaagacggttacaagatgccaggctatccggtattgccaattttatcagcgttgttcacgtttttcttgattacacaattacatcttgagacattagtggcagcgctagtgtggtttgtattgggaattattttgtacttaacgtacggcatgaaacattcacgaatgaattagtcgatttgttccacgtgaaacaaaaaacgaccttgggttaacaaccagggtcgttttttgaattgtgcactttttctcaaacttatgttataataaacatatgaaataaataacatgtattgaacggggagaaaatgaaatggaagtacgacagaaattattagcgcggggcattcaattagaagtgatttcaatggcatggatggcgattgaatttgtgcttggtgtgtctgcggggattcacgctgggtcaattttgttgattgcatttggtcttgatgcatttctggaaacagtcgctggtggcattttaatttggcgcttgcgtgctgaatataacggggcagatgccaagacagtggtacgggttgaacgcacggctagccgtttggtgaagggaattctactattgctatcgggctatgtcttgattacctcaattatgaatttgactaaccatgaaatgccagcggaaagtggcgttggtttggttattgcgattatgtcagttatcttgatgccaatcatgacgacgatgaagcgtcgcattggtgatcgcatccaatctgaagcattgcgtgatgatgcgatgtgtaacgtcacttgtgcggtgctagctggccttgtgttgggtggtatggtgttaacggcattgtttggcctatggtgggctgatgcagtggcagcaattctatttgcgatttacgttggtcgtgaaggtttagaattgtttgaaaagtaaacaattaatatgtaattaataagctggatgatattgatttaatggtcaatgtcacccagattttttacgcgtctatctgaaaaatgacgactcgttaaaaaatgaaacttgtgaaagcgttttcatacgagtagcgtaatacgtgttgataggaatttttgattaggaggaattattgacatgtcgatattgattgcgttggtaccagcgttagcctgggggtcagtaggaattgtgaccaccaaggctggtggaacggctgctcaaggaatcatggggatgacgattggggccatcttgcttggttttggtacactggcattttttgttattccgaatgccggcatggattatgcatttaattcacgtatttggttggtaggatttatctcaggattaatctgggcagttggtcaggttggtcaactaattggctttaagaaattaggggtgtcgattggaaatccgttatcgacatctggtcaaattgttggaaatgccttgatggcagctgcagtgctgggtgaatggcacacgggtcgcatgtggttctttggattgctatcaatcgcgttagtaaccggtggagcacttttgacgacggtacgcgataagaatgcaccggtcgaaaccaacccagaacgtgattttaagggtggtgtgacggcggtcatcgtctctacgctggcctttatgatgtattttgttttgccgaacttgttgaataagtggggctacatttcagatgccatccacaaccaaaataatggtttggattacatgacggcaattgttgcgccacagtcgattggacaaattctaggcgctttgctgattgtggccttttacttcaaggagacgcgcaacattttcaagattggtacggcacgccaaattattactggattagtttgggcacttggaaacgtctttatgttcatctcaacaggaaatccagaagtggggcaagcaacagcaacaacgctttctcagactggaattatcgtagggacgttcggcgctattttcattcttggtgaacgtaaaacaacccgccaaatgggatatattttcttgggaacggtgttggtaattatcggggcaattttgatttcaaagttgtcagtattgtaagtgttttaaattgggggaattaaaattatggcacttttgggagctattgaagcaggtggtacaaagtttgtggttgcggtagcagaggttgaaaatccagatgtcgttgtcgcacgtgaaagttttccgacgttggacggtgcgggaacgattgcacaagtaatcgatttctttgatcgctatgatgacatcgcagccatcgggattgcggcgtttgggccgattgatatcaatccggatagtcgtacctatggttatgtcttggacacacccaagcgtggctggtcgggatatgattttctcggtgcaatgaaggcatggcgtgacatcccgtacttctggacgacggatgtgaacggtgctggctgggctgaatatgtatcaggtgcagctaaagacgttgaaaatgtcgtctatctaaccgttgggacgggtgtcggagcgggtattattcaacatgggcagttattaagtggtaattctcacccagaggccgggcatattatgatgcgtaagcacccacaagattcttacgttggtcactgcccgttccacggcgataactgcttggaaggattggcagccggtccagctattgaagaccgctggcaagagtcggctaagtcattgccagatgatcacttggcctgggaaatcgaagcgtactacttggcgcaagcagccgttacatacaccgttattttgcgtccagatcgcattgtatttggtggtggggtgccacaccgtgaagtattgttgccaatggtgcgcaagtcatttgctgaacaactggcagattacctaccagttgatgatttggacaagtacttggtaacggtcgggaatggtgataatgccggtattctaggttgcttctatttggccaagcaattggttgaagcttaattaatgaaaaacgcagtgattcgcgattgaatcactgcgttttttgtgcccaccataaattggctaacggtatgcgggtgtcgccgataatgatgtctgattcggtataaccggtgactaaaccggttataatcggtggcaccgcaccatctgtatctgaataattttcttgcacggctacttcttcgtgtcggccgaaagcatcgaatatgatggcagtcatatcagctaagctcatttctggcatgcgcttacgattttgacgggcaaattctaaggcttccttctttttaacgtcttcagtgtggtcagaaaggtagtacccctgccatttaaccatgccacgatcttgataatcatgactgaaaaaataggctgcccgttcgaacatatcatgttcatcatccataagcgtttcctccgttgtgaccaccgaccagaccgatacggttaagcattgtgccaccggcaacactggaacttttgaagacagcgccaacgccaaattttttacggatatcatcaatgacggtatcgatggttcgttggcgcgtattaatcacaacaggggtaaaaaggtcgatttgttcaacgccttcgggtgctaaacgaccggcactgacgtaaacgttgcgcacaacttgtccctcgtaatgttgtctaaaaatgtcgcggagggcattggtgattggcaaactaagattggttgcatcaatcgttaattgccctccgaagccgtgagtttgatttgtttcacgataaccaaagccgatgccaaggctaatctgactggcaaccacgtttttggcacgtaaacgactcgcgacctgctcaccaatttcacgaatcacgacttcaatttcgaccggattgtcgtagtcccgaggaagaacttgcccgttactaaacgaactctcttttggccgatatttgtgtttaatcaaactacggtcaatgccccaggcaagtgcgtaaagttcgacgcctttaacgccgaatttttctttaagccggtaggggttagctgcagccaaatcacgcattgaaaaaatgcctaaacggcgtaattttttagcggtacgtgagccaatgctccaaacgtcatcaagtttttcgattggccacaaaacatcggggatggtttcataatgccattcaccgattaaatcggtggcgtgcttggcagttaaatcgagcgccattttagccatcgccggattgtcaccgatgccgacggttagatagataccggttgcgtcacgaacttcttgctgaatgatgcgggcaacttcgtaatccgtcagggtacgatgatatttggactctaaatagcgccaactatcagttaggtcgagtaatgattcatcgattgaatagatgtgtaaatcctcgtcagcgacaaacttccgatagatgtcattaatttgtttgtttttttgaatatagtaattcatacgaggttggacaatcgccaaccgaggatcacgcggcacatcgcgctgacgcatcacattggacaccccaagtacttttttagcctggggtgaggcggctaagacaagtccgccatttgtgttttcttgttggctcataacaactaggagcgacttgagggggttaaggcctaaatcgacgctttcaacgctagcataaaagctttttgagtcgataaccatcacgtgcctggcggtttctttttggtagacatcaaccatcagaatgacctctatttgtttatattaggttcatcctaacattaggataaacctaatatacaccctttagaaaatctttgcaaatgtgaaaacaattgatatgacgctgttttgggcacaaaaatagcaccaacccgcatggttacgcgagttggtgctattacttttaatctctaattattaaccaaagatgtggtgtgcgatgttttcggcatcacgcaagttcttgtcgtttacacctgaacgaggtgcgaacgtcgtaaaccatgaccaaccttcagtagggacaccccatacgtacaagccgtcgacttcgttatcgttttcatcgataacaaccaacgtttccttgttcatacgagtaccgccaacaacataagtagatccgtcggccttcgtgtattctgcagcgctcaaaacgccacgatcacgcaagttagcaaccaatgggttaactgagtttgccaatgaaacagagaacaaacgagcttcaacaaggttgttaacagtccatgagttaccacggttatccgttgctaggtagtgatcatcttggacagtaacggccaagccaggaccagcaatcgtcaaaacgccagcttcaatcaaagcacgcatttgctcaacacgtaggacaggaggtccaacggaaatcaatgagttgaatgggttgaactttgaaaggaacttggcgtactcgtcagctgacaagtaaccagcgtccaagtagtgacggatgataccacgaacgtcacgcaacatgtcgaatgcaccggcatatggcgcgtcgttgttaccttggtaagcatcgttgatgtcccaagttaggtagttcatcatgaagtcgctgtattcaacttctgcaggaacatcgttgactgggttcaaaatgcgctcccagtccatgatgtattcttcggaaataccaaacttacgggcagtttcattcaagttgtcactttcggccaaagcgttcataaacgtttcggcgttaaatggccaagtcacacccaaatcgttaatcgtgttttggtagtgcttgtactccaattccttacgcaatagcgtgaagaattcatcgtaagaaacttgaccgtttgactttgcagccaaggcgtccaagttttcgttagtaaagaactttggttggtaaccttcagcttcgaccttttggttaacaccgcgggcgtgcataggcaatcccttgcgagaaccggcaatcatgtgtggttccttacctgatggcaagtagtacaaaacaccgttgttatcacgagagaagcgaccgccacggctgatagtcaacttggcgatgtagtcaaagaaactcaatcccaaaccacgcaaaacaaccttttcgcgagctggaacggcatccaagtcagcttctgatgggtgcgttggtgcaacgtacaacaagtcagcattttcatctgctgcggcagcgaaaaccttttgctcgtcgtccaagtcgttatcaacgtgacccaaagccataacaacgtgatcagccttaactgatgaatcgtcatccaaagttaccgtgtattcgtcaccattcttcacaacgtctgcaacagacttgcgttcatatgacaacgtcacgttagctggtacgtgggcacccaagtgttcaaagaaccattgtgagtacacaccaaacaaggcacgtgaagtgaaacggttagggttaatacgcgtcaactcgtccaagaagtaagcttcgttttcgaagttgtgcatcttaacatattccttaccgtaagttacagcccactcgtagaagttaggtccgtatagggcagtagatgcatggttaggaactgatggatctgtgaacaacgtcaattgttgcgtcacagtgttcatcaaaaatgttggatcttgatctggattccaaacacgacctccgattgggaatgggtcgtataacgtaatgtctacggggtcagtcatcttcttggcgtgcgccatcaagcgctcaaccaacgtcaagtttcgaggaccagctccgaccaatgcaatattcattagttctcactctcttcctgcttaaatgctgctaattcttcgggtgaatagataccgatatccttcacgtagatgttaccggcacgcttcaaaccttcgttttgtagcaacccttgctttgggtaggcaaaggttaccgttgctgtggcacgaatggcagagccaaggatttctcccgttgtcgcgtgcaagccagatggcacatcaactgagaccactggaatgtttgcggcattcactcgtttaataatatcaccaagtttgcttggaacgggcttagaaaggccaattccaaacaaagcatcgacgataaccgtgtaattacggaaatcacggacacgattttgtgtttcaatgccgtatccgcgcgcaatcttcaattgggtagctgtgttagccgtcgcgcggtgttcgtcacctaggataagtaggtcaacgttgacacctttttgggtcaacatacgagcaatagcgacaccatcaccaccgttgttacccaaaccggcgatgacgaggacgttagccaagtcgaatgacccagctgcgagaacatcaatcacagacattgcggcgcgctccatcaaaactaatgagggcacaccaatttcttcaatcgtgtaacgatcgaatcgttgcatgtcttgtgcggttactgcttcaaccatgaaaagtaacctccttaatttaataggtataatagcaaaaacgtcgattaggacgttcacagtttattatatcgcaagtcactgctaaaatgtctttaggagcgtgtttagattgacacaaagtaagtgaaggaaagaaggactattcataatgaatgaaggatcaatcccagaagatatgacgcaagtggctgaccgtgttgctttgatggcagcgcgtggcttcccagttagtgaagatgatgtgattaaggaagcactaaagctaggtttccaagacattatcgatgagcgcatggaaggtaattactttacggttcgttgggatgaggatttccgcgccctacaagtattcggtattgggaacgcctatgaaggtgaagcaaagccggaagatgaacaacctagctacattgagcaatttatggcaaatgccatgaatgtttggcttgcactagaccgcgcagcaagcaaaattattggtcgttaaacttaaaattcttttaatgccaaaccttaaagctgaatttaagactggttgtgttatatagtagggacagaaattattaatctcgtacggttatcgtacaaatgtaaattaagggagttttttatcatggaaaacatgcgcaagtatcttgccgagttcttcggaacgttgatgttggttgccatgggaactggcgttgttgtcttcgtcggaactcaagctggtccattgccagttgctttggcctttggtttggctgttgtagccggagcatacgcctttggttcaatctcaggtggtcactttaacccagctgtttcatttgctgctgccattaacggtcgcatctcatggatggatttcttgggttacgttgtttcacaaatcatcggtgcctttgcaggttcagccgttgttttgggattcatgaaggctttcggtgctccagcagcaacgattaagcaagttggatttggtcaaacgaactttacgtcaccaatttcattcttgtcagcttcattgatcgaagcattcttgacgttcatctttgtcttggtaatcttgatggttactgctaagaagaacgcagctatctcatcagttgcaccattcgtcattggtttgacgttggctgcattgattatgcttggtttgcaagcaactggtgcatcattgaaccctgctcgttcattggcacctgctgccttccttgcaatcttcggttcatcagctgcattgactaacatcggtgcctacatcgtaggtccattggttggtgccgctttggcagccgtagttgctaagtttggtttgggttctgaagaagactaataatcaatcattaaaatgcgtatcgtccgtgtgacgatacgcatttttgttttcaggacaaaaataatgcctttattttgcacactcgtgacgaaagaggctaaaataaaatcaacaaatcaagattggtcaaaccaaggagggatttcatcatgaaggcagtacaaattaaggaatttggggatgttgatgtacttgaggaagttgaagtcgacacgcctaagattttgaagaagcaagtattgattaagaatcatgcaactgcaattgatccttatgatgtgaagtttgtacaagggttgatgggtgaggcagacaagctaccgttgattcctggttcaagtgttgttggtgaagttatcgcagttggtgaagaagtaactgactttaaggttggcgatcgtgttgctgcaacgcgtcaccaccaaacgtatgccgaagaagttccggttggtcaatctgcagttgctaaggtgccagacggtgttgatgatgtccacgcagttgctgctgttgtcggtgcggcaactggctaccaaatgattacggatgatttggatgtgcaacctggtcaaaaggttttgattcaaggtggtgctggtagtgttggctcagttgccattcaagcagccttgaaccgtggtgcaattgtctatgcgacggccaagccagctgactttgactatctaaagtcattgggggatgtaacgcctgttgactaccacacggcttatgagaatgacttgtcagactttgatgctgtgttggatacaattggtggggatgttgccattcaatcagcaaaggtgttgaagcaaggcggtaagttgcgtaacttgactggttttgatgaagacgcaattagcaagtttgatattgacgcggttcacacttatcaaaatggtaagcgtccaaacttggaagcgttgttggatgacatggctgctggtaagattgtggttaaggttggggatattaagccattctcagttgaagcattgcgtgaagcacatgcagcagctcgccaagcctcattggcaggtaagacggtatttaccttttaattaaagattaaaatcaggcgattgtttcatgtgaaacaatcgcctgttgttacaatacgggtagagggatttattattatgttatttacagaacgtgattattacgaagatgttgttgcgatgcttaatgcgcgtggtgttgagttgaaggatattgcagagttagtcttgtttggacaacgtgcgattattcctgatttgacgatggatgatgcgattgattcagtccaacacgttttgcacaagactgaagtgcaagatgcggttatgactggtctagccatcgatgatttggcagaagcgaagcaattgccacaaccattgcaaagtcgcatcgaccgcgaccacggaacatatggtattgatgaacaacttgtgatgtctattttgggtgtgtacggcacaatttcatggacgaactttggttacctcgatcgtatgaagccaggtattgttggtcgcttgaacgacgaacaacaccgtggtggccgcgtgaacacatttattgatgatatcgtgtcagccattgccgctgcagcacaagcgcgtatcgcgcacgattaaaaaataggacgcacaaccatttggttgtgcgtcctattttgcattgtcagaattacataatgccgtttgccttggcagcttcaatcaaatcaagctccttggcactttgaacaggtgttggtgtaccgtcaacgttaattgactcaatccccttcttttccaacaacttcttcaacttattcttttgtgacataattccattacctcctgcacatcaattgcgcgtcaggtgtttggcccggcgtgtatgtctacgtttattagtgtagcgctttgtcggtgatttgttaaattatgtgtttaatcaattttaaaaatgttgtatgacactatttcttgcgcggtgtaattaaaaggcgtagcatagtttctcgtagttttgtctcttgtataagggagagatacataaagcagactgggaatgtcagatgttttagaccaacagctgctgtgatagagatatccgaccgattgtttcacatggaacaatcagattgagaaaatataggatcaaaggtgggaaaatgagtagagaaataaaagttgccttattgatggcggctagtttatttatggatgtcatggacggtacaatcgtcacgacggcattgccaaaaatggcgcagaactttaatgtgtctgctgccacaattagtttgttggtaagtacatatatgattgcagttgccgtgtttattccattgagtggttggattgcgcaacgtttgggcaacaagcgcatttggttgttagctgtggcactgtttacggttagttctttgggtagtgctttagcgccaaatttcgctgtgctattaacgatgcgcgtaattcaaggaatcgctggtgccatgatgatgccaacggcacgtttgattgtgttggaaaagacgccagctaatcagctactccgtatgattagttatctagtgtggccatcattggtcgcaccggcattggcaccggtgattggtggtatgttcgtcacatacttcacttggcactggattttcttgattaatttgccaatcggtattatcgcctttttgatcgggttgcatttattgccaaaggatgaggttaagcaagcacgtgcctttgacgtgcgtggtttcattgagttggccttggcatcggttgctttgttggcgggggcagagatggtcgctcgtactggtgcagttgtttggtacggattgattctggtagtcattggtatcttgttaggtgtgaatgtcttcttccacttgcgtaaggctgagaatccattattctcagttgatgccatgaaggtaccgacgttccgtgttttccaaactggtgggaccatcttccaagtgacgattgctagtttgccatatgttttgacggtcttgctccaaacggtatttggctggacggctgcgcgtgcaggttggtatgtgttgtttatcttcgtgggtaatattgggatcaagccattcacgaatccaattattcgcaagatgggcttccgcggtgcattggttgcctcgttctcgatgttagctttaagttcatttgctttggcgttggttcgtccaacatcaccagctgtttggattatgttgttggctttgatttctggtgtcggccgttcattggcgtttacgtcatataacggattgcaattcactgaaatcgcgccagaagaccgtaacggtgccaatacgttaacagcggttacgcaaagtatgggacaaggattgggtatttcattgattacggtgattattcacttgttccaaacgcatttctcattgcaaggcgcgtactcatggggcttcgttgtcctgggtgtattcgccatcataccaatgttggagattttgacgctgcctaaggatgcaggttcagaagcaattcaataataaaaaactagaccaattgtcagaaatggtatacgccaatttgacaattggtctattttgttccctttttaattcgcgcggttaatgcacggtgctatagtaatttacattgattaagagattgaaagagagaattggtacatgtcaattatgcttgctttgattcctgcggttttgtggggtgcgatgggaattgtgaacggctgggctggtggccgtgtcgcaaatcaaattttaggtggtgcacttggatcactagtattctcaattgttgttggcgtgtacgcatacgttgaagcaccaaccacatcagttgtctttagtatggcagggttgacgtacgtcctttcaggaattgcctgggcagctggaacgagtttccaactagccgcctttaagaagatgggtgtatcacaagcgtcaggtttgaacactgccggacaaattgctgtgaatgccttggtcggtgcagccgtgtttggagaatggacgggcgcacaccaatggacaactggtttgttggccattgcctcagtaattattggtgtgttcttgatttcaggtaagccatctaacttgaacaaagacggtgttcgtctaacagctatctccgtctttgcctacatgatttacttcatgattccgaagacggttgctattcttgatttggttcacgtaaacacgggtacgttgcacaacacaatggcattatcattgccaattgcgattggacaaacaatcggtgcgttggtcttcggtattatcatctttaacggtggaaacttgagcttgccattgttgacgaaggaaacggctaagaacggaatcgccggtgtgatgtgggggactggtgaagtgatgatccgtttggcagtgttgaatccagcagttggacaagccaaggcatcaacgttgtcacaaatgggaatcatcgtttcaacgatgggagccatcatcatcttgaaggagcgcaagacgaagcgccaaatcatcggaattggaatcggtgcgatttttgttatgctaggtggtatcttggttacaatggccggttaataaataagctttaatccatcattcgtttggttgcggatgatggatttttttgtggttagtgtcgtgccagcccaaccaaccgccagtggcgaaacatcaagttatataaattccaaaaactgtaaaaactaaaaatgtaaataaaatgagaaaaggctagacaaaccctatacctagatgataaagttctaaccatactaaaaacgccaaaaggagggcagacctatgaataatcgaattagcacagctatgatcatgacgacgtcctctgactcaaccacccgtttgtggttgagtaactttgacgtgcaataataattgtatttcacaaatccactcaaccatgttggtacccctatacacagactgtataggcataccaggggttgggtggcttttttgtatacttagtaggggctttaaggaaagatgaggtagacattatggtaggcaatgaacgacatttgaaacgctcaatgggtgtttggacgggtatttcaatcgttatcggaacggttattggatcaggtattttcttcaagcaagggcaagttttggagaccgctggtagcacaacgggtgctttgtgggcctggattgctggtggtgtggtaacgttggcagccggtttgacgatttctgaaatcggggcacacatcccgcaaacgggtggtatctacatctacatggaaaagctttatggtaagttttggggcttcttgacgggctggacgcaggttgttgtctatgcaccagctattgtggcctcaatctcagcttactttgcctacttgtttgcgaatttctttgggttaccagagagcagcgtcgtctggattggtttggcagcgttggtattagtgacggcgatgaactcattggataatcgcattgcctcaatgttccaagtcgcaacaacaagtattaagttgattccgattgccgtgttgatggtgttcggtttgttcttcggtaaggctgatgcgttgggccaaacggtttcacaattgtcatcaacggcaaccggtaactttggaatggctgtgttggcaacgttgtttgcgtacgatggttgggcaacgttgacgaacttgggtggtgagttgaaggacccacgtcgtaacattccacgttcaatcatttggggtgtcttgattgttatgattgcctacgttggtgtgtcatacggtgtttaccgtgcaatgccagctgatcaaatcgtgaagttgggcaacaacgtcacattcgaagtggctaagtcagcgttcggtgagttaggtggtcgcttgttgtcagttggtatcttggtctcaatggccggaacgttgaatggtaagatgctagcattccctcgaatggtttatgccatgtcacatgatggtgtgttgcctaagttcttgggcacgttgaacaaggcgcaagcaccggttggcgcactttggacgacggctgtattggctggtgcattgatgttcacatcaaaggctgactggttgtcagacatggctgtgtttgttatctggttgttctacacggcgacgttctttggtattttcatcttgcgtgcccgtaataagaaggctggtttagaaaaggatccggaagtgtttagcgtaccgctattcccattcatcccattggttgccatcttgggcgcattgttcattttggtaaacacattgatctcaagctttacgatggtcttgatttcattcatcttcgtgggtgtcggcgtgccggtttacctttactacaagaataagcagtaatttgaaaaggcgattgtgatttgttcacgattgcctttttcctatatatagtggttaacggtatgaattgcttagtggaaaatttcggttttggtaaaaacggcgccaacttaatgtaagtaatttaggtaatatcatcttgtacttaagttacaaataagatttttgaggtaaggaactatgtcatacaagtcaattttggctagtgctgccgttttggcagctgtagtgggaactactggagttgttgcaaacgctgattcaactttgccagcagctacaagcacaactaagaacgatgcaaacggatctgtatcaggtaactcagatgccacggtaaaggttgaagaaggattcttgactttggatgctgtgcctgacatgaacttcggtttgacggcgcaatcaaagacggcaaacaagaacttgccattgattaacaaccaaggtttgatttctgacgacggaaacgattcaggacttttgaaggttacggattcacgtacgtcaacttcaggtgaagagggttcaacgacaacgacgacaatgccttggcaattgacggcaacgttgggtgattttgctaacgttgacggtactgccgttgcaaacctttctgactgggcaatcaacttgaagcaaacttcaggtgagaacacgtcaggtaagatgccaagcttgtaccaaccaaagcttgtttcaggtgacaagacgcaacaccgtgtcatgcaatcagcacaaggtacgggttacggaagcacgagtgtttactacaacaaggctaacacggcatcattggacatgggtgctaacgtaccagccggtcaatacgatgcgcctattacatggacactaaacgcaacgcctaatgcttcggtaaactaaaacttcgcatctttttagggaccctgaataagggtccttttgtttattaaggggtgaaactgatacagagggagaaaaataaccatcatgacaatgacgtttaagcgtttattgaagccgctatttatggtgttagcaatgttgcttgtgttcccgtttagtgcggtaaccgctcatgcaaccgggacatcagaaatagcgattgcgccggtatatccagaaaaccaaattgcgcagaacggtatttttaatttaaaggtaacacctggtcaaaaagaaaccatcaaacttaagatcgctaatttatctaaggaagatcaaaaagtaacgattcagccaacgacatcatacacggctgattcgggcgttttgtcgattgatcgtgtaaaagcacctaaaacgactacggcaccggtgaagttccgcaatattgttcgcaaggcggatcacaaaaagaccgtcacgattcccgctaacgaaattgtggaagtgccgtttacgtttacgacaccaaagaagccgtttgaaggtgttgtggtaggtggtttattagtaaagtcagcgactgaagaaaatccattaacccacaaaggtgtgagcgtaaagaataagtttgcttacacgatgtcggttgttttgaaagaagaagacaaaacagctgagcctgatttgaagttgggtgaaattaaagccggtcgtgttggcacagatattaaggtgaagtcggtttacaagaatatcaagccagccattatcagtgatatgacggtgaacgccacgattacgactaaagatgatggcaaagtgatgggtaagacgacggaaactgggttgagcatggcgccaaattctagtttcaaatttaccaataattgggacaaaaagacgattaagcctggagactatcactacaaagccgaagtacaaacagctgatggccaccattggacgttagagaaggactttacggttgatattgcagatgcagttgtgattaatgatcactacaacccatggattaagtggattatcttggccgttattttgattattttgattttggcaatttggtactacatccaccgtaaaaagaaggcggaacagaatcaagcaagttaagttttaaaggaggaggaatgatgcgtaaaaaagtggggatgctattgtcagggttgctatcactagcgctgttggcggcaccagttaatacgattcatgcagaaacgtatggtcattcagatgccggtgttggtgtaaaaaataaaacagccgatcagagtcaaacacaaagctctgaagatgatttaagcaacagtaatcgaccaactgtcatcgttgaacaaacacaattgccagagacgagcgccatgatgaagggcggcgtttcgacgttggttgtgattttaattgggtcaatgggttatgcctggtatttgactcgcgataaaaagcaagaaaaatgacagtagcgatgaagaaatgggggattctgagccttagctgtttattgggattgttactggggactaatgtgttggcgacaacgctgaaaggtcaggatttaaccgtcgcgcctgtcattagcgaatcagcgtcgcaagcaaagccgaatatttatagttttcactatgaagcggaccatgactacactgttgaagctgatatcacgaatacggggactgaaaagcgccgctatcaagcggagatagaagatgcctatacaaatcagaatgggcaactagtatatcgtgatactgacaagcgtcaaggtattcgtaagttgactgataaaccaaaacaaacggggaccatcgcaccaaatgaaacgaaacgtatcacgtttcatttaaaaacgaatcaagaaccatttgacggggtgaaaattggcggtttgcgtgtgacagagttagcccaggcatcaaagaatgatattaaaaataatatctcactcattactagtatcgtgatggcgacaagtgaaactgaaacgacggccgtaagcggtcttgatgtcacgaatgtggctgatgttttcacgacaactaagcgaggttacgaatttaaattcgacaatgatacagcgcagttgttgactggggttcaggcaacgttgacgctatataaccacaacaagaaagttgctgaaaagacgttgcagccaattacaatcgcgccgaagtcgccatttaagctgtttttgccagtagatggccgtccagatgcgtttaccaaagcaactgtgacgtttaaaaaggatgatcaagaaaaaacggtagcgtttaataatacaaaaccatcgccgggcacgacggataaacccgaaaagcataattggacgccttgttattggggtggcgggctactcgtgactggtcttgctggtggtgggtattacttagtgaaaaggaggaaccgtgatggagcataaacatggtcggctgcgaacgatgatgatgttggctgctgtgttgctggggttcgttggtgtgccggtaggactagcgccggggctaacggatacgcagtctaacgatgttaaggcagcaggtgttgtgccggcaccaccgtcatcaggtccgaacgtggctggaaatttttatatcaatggttacacgccgaaacaggatgatcagtatcgcaacatgcaaatcatttctgacgggacaaaaagtacctatgaaaccatgtggtataaaaatcccgtcaatattaataagccctttcagaccaagttctatatctatatggcaggagatgccgatggactaacgttcaccttgcaaggtcaggggccaactgcgcttggtcagaacggtgaaagtctgggtgtctatggaacgattcgtaatagcacttacagtggttatattcgcaatgccctgagtgtggaatttgacccctatcccaacgcggactatagtgattcgcaagttgttaatcaacttgggcggtcaggtcacgtcgcatacgtccaccctgatgagtatggtagtactggcttctttggaggcggtaagaagtatatgaagcactattcgccttttaaggctaatatgaatgatgcgaaatggcactctgttgttattacatggacgccgaatacatcgactggtcaagggacgatgaatacgacgtttgatggtcaacctgtgggtgatcacacggtaaaactatcgcaatttggtaatggcaatgtctactggggattcagtggttcaactggagctgaatcaatgattggtgccgttgcttatacggaagttattcagcaacctaatttaacgaagctggttcgcaatgtaacggctggtgagactgagtttaaagatagtacaactgcaaaagttggtgatacgttagagtatcaatttgtggttgaaaattcaaagttgaatggacttggaaatacctgggaaaatgttgaaatcaatgatgatttaccagatggcattacgacgctggatggacaaaaacacattcaactatcggttggtgatgttccggtggatggtcgggtaacgaagacggttcaaaccaaggtgacggtgaatgaggatgttgccttgcgtaataccgctttggcaaccggctcaaattactacgtgtcaccgacgactttgttgtcaaatgacgcgattgtgaatgttcagaagcaggaaaatgtaaatccggttaagttaaccattcaaaatcagttgtttaatacgacgtatccggatgatcataatgcagccaacacaactattaacagtgttttgccgggtgatcaagttcggtatgtgacggatattaaaaatacggctgaggcatcatcaatgacgaatggtgtctaccgcttcgaagtgccagcgggtacggtatttaatcaggtgaagctgggcgacaagacgctcacagctgggaccgattatacggtaactcatcaaggtaccacggatgtcgtgctcgttaataacgttaactttgttggtccgggaagtcttgaatttactgctgatgtgacaattggggatgccggtggtaaacaactttcctttgacacgctgccatttgtgaccggcaataacccggacgggactaagtttacgactgacggaacgagcatgacgataaactacaccgacaatatgctcaaattcacgccgaagaacattgattatggtgcgcatccgtttgtgaatacggatcaggtgttcgatcgcacagatgcaacgaatgcaccaaatacagttgttgatgtgaaagatacacgtcgtgacaaatcagcgctcaaggtatttgttagccaagatgcaccgttcaagatgacggataatatcaatgccgtcttaccatcgaagttgtgttactatgagaatggtaatttcacaacgttggataatgacggggtacagattggccaaacaaacgcaggtcaagcgttgtcagccattagttggcagaaaaatgatggcttgagactgtatgctaacggtaataatttcatgcctggtagctaccagactacgttaacttggacagtggttaacgggtattaaaaaaacaacgccttacgtgtgtaaggcgttgtttttagttattcagcaacttgcttgtgcttattcgtagcgaagaagaaaattgatagcaaaatcaagaatccggcaccaatcataactgagatacgcgtctcaggattgataaacatgaagacaacgattagcaacaaagcgaagatggcaaagtaatttgatagtggataaagcggcattttgaatgggtgatcctttagcagttctttgttcgaacggcggaatgacaattctgaccacaaaataacgaaccaaggcaccataccaggcaacacacttgagctataaacaagtacgaagatgttagccgtagacttgctgtagattgatagcacagtgttcaaaatcaaaccaagcaagataccacctgaaattcccaagattgaaacgtaagggacttggtgtgatgacaacttttggaagatgcctgacgtttccttgtcacgagacaacttgtacaacatacggcttgaactgtagataccagagttggcacctgacatggcagccgtcaacacaacaaagttaatgattccagcagctccggcgataccaacctttgagaacgtctcaacgaatggtgacccgacggcagccaattggttccaagggtaaatcgtcacgataacgaagatggcaccgatgtagaaaatcaagatacgccaaacaactgacttaactgacttaacgatggcgttgcgtgggtcagctgcttcaccagcggtgataccaagcacttcgattccttgatatgaaccaacaataattgaaagtgagaagatgaatccctttacaccgccggtaaagaaaccgccgtgtgaccaaagatttgaaagaccgattgcgtgccagtgattacctagaccaaggaagatgaccattacaccaatgacaatcatcaaaataatcgtcaccaccttgatcatggcaaagtagaactccatcgtaccgtacgctttggccgaagcgaggttggccagcgtcaaagtcgcgatgacgacgacacccgaaatccaaccaggtaggttaggccaccaataattcagatacgtactaacggcaatgacttcactaataccaaccacgatatattggaagacgttactccactttgttaggtaaccagccaaggggtgaatgtaattggttgcataatcggcaaatgaaccagtcgttgggttgatgaaaatcatctcacccaaggcacgcatcaccaggtaaagaagcaacccgacgaacgcgtaggctagcaatactgaaggtccggtccacttaatggtagaagttgatcccataaagagtccgactccgattgtgccaccaagggcgatcatctgcatttgatttgacgtcagggagcgcttaagctgcacttcctctggttttttatctgccatattcctgttctcctctgtgtatacaaaaagaccgtccaaccgaacacgcaccgcgatagggtgtcgaactggttggacggtctgttaatatcgtttgttaacagcacattaaatatcccaaccagcgaaaatggtggttgaggtggtggttgtcataccaacaaattgatttgcgttaataaaatcgttcatcatgatgacgaccaccctttctgtacttaataattagaagtttatcattattacttttagttcgcaagctaaaaaggaacggaaaatttctcagacggttaaacgtttttatgaaaaatatttaataaaaagtcggaaatatccgagaattaggcgtttctggtgcctaattatgttgacagtaaacggttttaaatgtagaataatcacatcattttttaattatttagagtgcaataatagtgttttaggttattagttttagtagtgaaacgaggagtttttatggaacaaaagagtttgttctcgcgcatggcgcgaaaggaagacccgcaaaactacgctgacaaggatggacatttgaagccagtccttggcatgcgtgagatgattgctatgggtgttggaacggttgttggagctggtatctttacaatgcctggaatcgtggccgctgattatgcaggtcctgcggttgtcttgtcattcgtaattgccgccattatcgctggtttgtcagcgttggcatattcagaatttgcttctgccatgccatttgccggatcaatctactcatgggcaaacgttatttacggtgagttcattggttggttgtcaggatgggctgttttggctgagtacttgattgccttgacgctgatttcagcatcatggtcatcatacttccaaggcttcttatcaggattcggaattgcgcttcctaaggcgctaacggcatcgtttaacgcaggtaatggtacttggttcgacttgttcggtgctttgtcattgttggttgtcggacacttggtatcacgtggtgttaagggcgcagccaagattgaaaactggttggttatcggtaagattgcggttatcatcttgttcatcgttgttggtgcaacggcaattcaattgcaaaactggttgccattcgttcctaagcacgtgcctggcacgaactttggtggtgtccacggtatcttcatgggtgcagcgcaagtcttcttcgcttacatcggattcgatacgattgctgctaactcagctgaagttaaggatgcgcaacgcacgatgccacgtgccatcattggtacgttgttgattgcgacggtcttgttcgttggtgttgcgggtgtcttgacgggtatgtacaagtacacgaagtacgcaaacaacgctgagcctgctgcttgggcattgcgtgagtcaggtcacttgttcacagctaacttgctttcagttgtggccttggtcggaatgttctcaggtttgattgccttgatgattggtggatcacgtttggtttactcattcggtcgagatggtttgatgccacaagcattcgcaaagttggattcacgtggtttgccatttaacgcaacggttgttttgacggttttgggtgttatcttgggtgctgtcttcccagttggtatgttggctaacttggtttcagctggtacgttgattgcctttatcgttgcttcagttggtattttgaagttgcgtaagcgtgaagatattgaccactcaggttacaagatgccttggtatcctgtattgccaatcatctcagcacttgcatcattgggattgttcttctcattgaacaaggatgcgttgattttggcacttggatgggttgtcatcggagcgattgtttacgtcttgtacggtgctaagcacagtaacaagggttaatctaagttagatagaagagcgagttgcatgattgcgacttgctctttttgcatggctctgatgtgaaaattaattgggcgcacaggataacctgtgcgataatgagtgaataaataagtgaagtaggggagggtaggtcaatgaaagacgtccttgtattaacaactggtggcacaattgcgtcgaccaaaacagaaaacggtttggcaccaggtcttgatgctgaaacgttgattggttattttgagcgacgcccaggtgttaatctatcagttgaaagtgtcatgagtaaggactcaaccaacatgcaaccagaagattggttggatttggcgacacgtattcaacagcatcatgataactatgatgcctttattattacccacggtacagatacgatgggatatacggcagcaggcctctcatacctcctctatgggtttgataagccggttgtgttaactgggtcgcaagtgccgttggggatggttgagacggacgctgtgcgtaatctgcacgatgccctgacctttgccagtcaaactgacttgcagggtgtctacctggtctttaacggcctagtgatggctggtacacgtgcggtgaagaccaagtcgaagagttatgacgcatttgagagtatcaactacccatatattgccagtgtgtctgagggtaatatggtgccgttgtatcaaccaaaaccagaagaaccggtgttgacgccaagtatttcattggatccaaatgtatttgtgctgaaagcttttcctggattgacggttgatatcttcgattatttggctacccatgttcatggtgtcatcatcgagagttttggaaatggtgggttgccctttgagcgacgtaacctaattccaggtatcgagaagttgatcgcagcgaatattccggtcattatcacgacgcaaattttggaagagggtcaggatatttacctctacgaagtgggtaaaaaagtggctgatgctggtggtatcacggccggtgatatgaacactgaagcgattgtggcaaagttgatgtgggtactggctcagacacgtgagcttgagacggttaaaacactcatgcaaacaccaatcgcacacgacctggattttgtataatacaattaacgttacaaaaactgcctgttacaggcgttacaagcaaaagtgagggtgaaaatggctgatttgaagtatgatgtccttgaaaaatttggcgttctctcaacgagtaaaagtggttgggaaatgcaattgaattttgtacagtggggtgacaatacgccgaagtttgacttgcgtacgtggtcgcctgacggtagcaagatgggaagggattgacgttgacccacgatgaaatcgtaaagttgtatgaggtgcttggcgacgtgcttgcgggtgaaaatcgcactcaagcaccggttaaaactgaagcgcctgcaccggctgaagattatttagctgaaatgtattacgctgatcaggcggaagaagctgcggaggaggctgctgaagatgcagatcgtccaaagtggggtcgcttgggtgatttataaagccgactgggaatgtcggaggcttttagaccaatagttgctgtgataattaacagtattaatagttaggcatatgactaatcgcacgtggattgattctccgcgtgcgatttttgttaggtctgttaatcaagatgttttcaatgacaaaattgcataaaagacgtgtcttaaatgccttgataccggcgtttgtctcctctaaactggccttaacggatcaagggggatttgagatgcgattattagttgtggatttgggggagttgcgccagggaaacgtagattggcagttgtttgttgaaaatctgctagatggtggtgttgagacggtagttttgttgaatgcgacgcaacatgcttcggcgggtgcgccggttttctttgggaatggcgtgttaccacgtgacggcgtgacacatgtgtgggcagataatccagttttgttggttgatgaggcactacgtcaacgaggggaatattggcattgggcgtggtcaaaggttggtcgtcagcatggtgctgaatatggggtggcgattatccagatggggtggattcgtcgtgtttggtgtcgtccgttttcaagtgggaatgggattcatgtgtttgatgttggtcgtcacgttattgttgtgccaactgtaagtgggcgaggggagggccggccggttgaaatgattgaaagtacgcatgattatttgcatggtcaattgaaaccaatgtttatgttgccaccagaacaatggttgtatcgattgcgtgattatgattgggtgcgctgtgatgacttggcccaacagcgggtgcaatcgatgggagatgaaatacctgttgttgtggactatgatgctgcgattgtgtcgattgagccgtggcaaccattacttgatacaccgtttaaaacaagtttaattcatacgcttgattgaggctttttgcatcatgcaaatgatgtatcaaaggtgttttcatgatgttggtattggattgggctggggtctgcctgtgaatagttgtataatgtaaggaacaactacgattgagggtaatgacatgaacaaagcgccacaacgcgtgcaaggaatctttgatggcctcgcacacgattacgacaagatgaacgacattattagtttgggaacgcaccgtagctggcgtacaaagacgatggctgcaatcgatgtgcccaaaaacggccaaatcctcgacgttgccgctggaactggtgactggacaattgcgttagcaaaggaacttggcgaaaagggccacgtgactggttttgatttgagtccagaaatgttggcagtcgcacgcgaaaaagttgtggaagctggggttagttactgggtaactttgacgcaaggtaacgcgatggaattgccatatgaagacgatacgtttgatttggtgacaatcggttttggtttgcgtaacttacctgatactgctaagggtatgcaagagttgtaccgtgtgttgaagccgggtggtgaacttgttgttttggaaacatcacaaccggacaacccagtgatcaagcctttctggaagatgtacttcaagggtgtaatgccaatgatgggtaaggtgtttgctcacgataaggattcatacgattaccttgaaaagacgacagaagaatttatgtcatttaaggcgttggctaatttgatgaccgatactggtttcaagacggtcacgtaccaacgatttaattttggtgccgctgcagtgcactacggtattaaataaaaaactcttttcctctatatagaaggggaggggagaacaaaataaagacacgttcctaacggaacgtgtctttattagttgttagtccaaattgtaatcaatatccggtgtgactgtggcacctaagacatttttgaaatgccaaagtgcccaacggtgaccggttggtgtgaaacttgcaacgccatcagcgtgaacggtgatgttgtagttcaagttgtacgcatcaaccgcagtgtgcaaaatgcagatgtcggtatcgacaccagttaggtgaatatccttgatgtcacgtgagcggaggtagttatccaaatcagtgttggcaaaactgctgtaacgattttttggataaatccaaacgtgatcgtcatccttgtgttcagcgaaccaatccgccaagacgccatagtagtcacgaccaggtgtgtcggcgacgttgtgcgctggataaagttttgtttcggggtgataaggatcgttcggcacgtgcaaatcagttggcaaaatgacagcatcgccattagccaggaattcatctgccagttccactagacgaggcgcaagtgcttgtgctgactcgccggcagttagtggcccttctggtgcaacgaaatcatttgtgtaatcaataatcaacaaagccttcatgacaaatctccttaggtttgaccgatagtgacaatgcaatctctttctttgttggttattatacgtcttttgcggcggaaaacctacttacgaactggaataatcatcgcagtgaatgttgatgacgaggttagtttattggtttccatgacgtaggtgtcgatgcgccaagtttgaatttgacgaccagcgtggattggtgtcgcgatggcacgcaacgtaccttcggttgcttgagcaatatggtgcgtgtggatgtctagtccgactggcacttgttttgtgttgtctagtccgatgttggcgccgaagctaccggctgtttcggcaagcaaggcgttcatgccaccgtgaacaatgccgtatggctgtttgatttcatcacgaattggcatggttagaatgacttcttcggcggtcatcttttcgatggaaatgtttaaatattcaatcgcattcattttatttcaaaactcctatatatggatgtatttattttgtatatgattataaatttaaccaaagcgaacaagaaattgcacaaatggttaaagtgttaaatataagtttaacgggtctttggctaaattagtagaaaaaagctataatttactaagcacatatttgagatagagaatatcgaaaccagaaagtgagacttaacatgactgtagaatggacagcgattaaggaatactcagaaattttgtttgagcgttcagatgctgtagcgaaggttacaatgaacaaccctgctcgtcacaacgcgtttacgcccgtgatggtacaagaaatgattgatgccttctcaatcgcccgtgatgatgcctcaatcggcgttattattttgacgggtgctggtgacaaggccttttcatctggtggtgatcaatcagttcgtggtaacggtggctatgttggccctgaccacattgcccgtttgaacgtattggacttgcaacacttgatccgtattattccaaagccagttattgcgatggttaagggatgggccgttgggggtggaaacatcttgcaattggttgctgacttgacgattgctgctgataacgccatgtttggtcaaactggtcctaaggtcggttcatttgatgccggttatgggtctggttacttggctcgcgttatcggacacaagcgtgcgaaggaagtgtggttcttgacgaagttctacacggctgacgaagcttatagcatgaactggattaaccgtgttgtaccattggctgaagttgaagacgccacaatggaatgggcaaacgaaattttgaagaagtcaccaactgctattcgcttcatcaaggcagcgatgaacgctgatactgatgggttggctggtttgcaacaattcgctggtgatgccacgatgttgtactacacgacggatgagggtaaggaaggaaagaacgcattcctagagaagcgcgaaccagacttctcacaattccctaagttcccataaagtaaaaagaaaaaacgagccccgcatcgctgaatgactgatgtggggctttgtgttgaaaggacattgcaatggaaaattggctaacgaagcgcgctatgttgacgccgaatcggatggcggtgcgctttgaagatacaacgctaacttttgctgaaatgcgacaacgcgttttgacaattgctggccaaatcacgcaacacattgatggtaatgaacggattgctttgattacccctaataatctaacgggttatttgatgattttggcaattcaacaacttggtaaaacggttgtcttgctaaaccgtcgcctgtcaccgcgtgagatggcattccaattagatgatgccgaaatcacaacggttatccaggatgatcgctttacgggtgaactaccagcggtcaagcaagtcgcatttgctgaaattttggcaacggctgcggaggctatcaatccagtcgcagatttcgacttggataaggtgacgtcaattatgtatacgtcaggtacgacgggtaatccaaagggtgttatgcaaacctttggcaaccacttctattcggcggttggatcggccttgaaccttgggttaacgccggatgatgtttggttggctgcggtgccgattttccacatcagtggtctttcaattatgatgcgatcattgatttacggcatgggggtcagcttgtacgagcgctttgatgttgcaaaaatcaatgccgaattgatggctggccaagtgacgacgatttctgtggtgccagttatgttgaagcaattattggcgcaactacctgagggtgcaaaatatcacgaccgtttccgcacaatgctccttggtggtggtccgacggatttgacgacgttagaaaaggcaaccgcagccggcattgaaattgtccaatcatacggtatgaccgaaacggcttcacaagtcattgcgttggatgctgccagtgcaactcagaaattaggctcagctggtaagccactgttcccagtggaagttcgcattcaaaaggcgactgacaatgacaaggttggtcgtattcaaattaagtcaccgaccttggcagttgggtacttgaaccgacctgataaatatgccgaatcgtttgttgatggctggttcgatactggcgacatgggctggctggatgatgacggctttttgtatgttgagggtcgtgaaggggacatgatttcatcaggtggtgaaaatgttttcccagatgaaattgaatccgtctacggcgaggcgacagcgattgatcaaatttcagttgttggtatcccggatgagcgctggggtgctgtcccagtagcgtttttgtcatttaagtccggtgaaacgatggattttgacagtctccgcacgtttggtcgtgaacgtttggcgcactataaggtaccggcgcgtttctttgtgacagataactttcctcgtacagcgagcggtaagattcagcgtcataaattgcgtgaccaattggcagaggcgcgagaaattaaataagaactaagtgagttggtgtgacattggtatacaccaactcattttttggtatatggcttttcttttttgacttacgtataataagtgagatagttttaatccacaatacaggaaagatgagaaggggcttatttatgttgggggataatgttgggccgtataaacgcccagtttttggtgtgaagaagcgcttgttggtatcgggcgcgacgttaatgatgttggggatggcgccggatgtgcgagcggatgatgctgaacatatgtcgacgatggttgtgggaacggccaatgacgcaagtagtgaaaacggggcccgagatcccaaaaactgggaatggtctactgatgtgagtgttgaaaaaactgttatgacaaccgtgaatggtgcggtgaatgctgatggaaaagtattgccagcgggaagcagttttgtacagttggttgatgcacgaattgtgaatgggtatgcgattggattgacgattgataatacgaccgggcaatatcaaacgggtgacacgttgtcgataccattgtatggtgagatgacattggcgagtgatcagcacaagcaaacgtttgatttggtgccagcgacgggtgctttgcaaaatgatggtgcgacgtttgcacgttacgaggtgtctgggcgcacgttgaaaatcaccttcaccacaacgccaattggtgaggtgtcttcgcatttaacaatcaccgggtcaacatcgtcgccgctacctgaagccaaaatttgggctgaaaaaactggcacggcaaaaattattttcggggatgcaacggttacggggtcgtttgcatttaagtcgcgttttcaagtcgatgcccctggtgttgcgacccagcagttattcactaagagtgatcaggtgagtgtgggaagttactatcaggatgacggctatatgaatgccttgttgcgagggaagcggctataaccgctaaaattcgtgcaacgggaacttttgcaacggaagatttaattcaattgcaacacgttcaaattgaacagggaacggtattgtcggcttcttcatccgccgggtattcaacctattatgttgttgataaaaatgcggcgggtaagtatcaagcaaccgttatctcggcgaccgttgcacagatgaatactgaatcaattgagtcacagaattatatcgaatacgctgaagggacgtctgatgatgagattgtccgtgacttagcgacagttggacgtggtgcatacacgattcatttgaatgccgatggatcatatacaatggcttacaacatgggaaacccgtatgcggactggggcattgataattttagcgacgaaacgtttggtgagtttttgctgaaccgtgatgccgacggtacattgacggcgacggaactgaaggctttagatgaaaatatcgctcgagctggcggagcaaatccatctgaaggaacagggtcgcacgggcatcagttctatattcactttgctgataatacagctgttaatgcggtgacgagtgtgttgaaaacctataatgcgaacggtgaattgttgaacacgaccaaagctactcgtgcggtcactacaccggatattgttgatattaagggacaagcccgcttgcgtgtgttccacattgatgaagcgggccatgagttggccgcgactgaggttaagattgcaaacccaggtacgccttatgaaacggcagccaaagaaatagaagatttccagttgttacgcgtgacggacaacgcaactggcctttatggcaaggcgaacgagacaacgtcggtcgtttatgtttatgcggcaacgttagtagatgatccagattatagtttcgaagatgatgttgaagaaccagaggatcctgccgtgccattagaagatgaaccggaagtgccgtcagagccgacagtggatgaaccaaatgagccgggacaaccaagagttgcggtgccagaagacccaattgtcgatgtgccaacgccaccaacagttgaaccacaaattaatccacaaaatccagaaccagaattacctgtgaaagacgttccaactgagacacctaagttagtcgtaaatcgaaatgtggcaccggttgttgcgctacaaacaccggatgttgaaacggtgaccttgaatagggtagctggaatgacgtcgtcaacgttggttgaaaaggtggcagttgaattaccacaaaccgcggcccgacagcctgataatgcttggctaaagtgggctggattaagtggtatggccttcgtggggatgctaattattcgtcgcaaaaagtaatcaccttttgcgcttgaatttctaaaatgagggtctataataatagtcaatctaggaaagggggtgatacgttttgtcagattatagcaatcaaacgattcgtatcgcccttgtataggaaacaagggcgatacgtaattgtatttagcccggtaggaaactaccggacggccatgcagattgcaatttgagatgtatggtcggaagacaccaggcggcgaacctggtgtctttttttgtgttttttagttggtgatcagttcgccctacagaaggggcaggtcactccgaccggaggtcggacacacacctccaactcaattggtcaaacaaattgcacaaaattggagtaagataaagaatatctcgtaacaagaaagaagattcacctatggaagttagtttatggatctgggtggcgttttttgcatttgtgattgtgatgctagcgcttgatctgggtatttttaataaagaaaatacggtaccgacattcgaaaagtcattgatgatgacagggatgtgggtagccttggcatttatttttgcgggcggtatctggtattttgccggtagtgaccacgcgctggattttgtaacgggttacctgcttgaagaatcattaagtgttgataatctctttatctttattctggtctttagcttctttggtattgaagcaaagtaccaacaccgcgttttgttctggggtgtgttcggtgcgctagtgatgcgtgtgctcttcattttaggtggggctgcattgctacaacgtttcgactggttgatgtatattttcggagctttcttagtttataccggattgaaaatgttctttgaaaaagaggccaaccagaacctggatgatagccggttgattaagacattgcgtaaaattttgccgattaaggatgattacacagagcctcacttcattattaaagaagatggccgtcattatgtgacaaaattcttggttgccttaattttcatcgaagcatcagacttgctatttgcagtagattccatttcggctgtgttggcagtgacgcaagatacgttcatcgttgtcacgtcaaatatctttgcgattttgggattgcgttcattgtattttgccttgtcaaagttgttaccaatgttccgttatatcaaatacgcgttggcgattatcttggcatttattggcgccaagatgctgattaatgagggtggtaagatgtttggctgggagtttgaaatctcaaatgccgtctcattgattgtgattgtcggcttgctagcattggccattgtgtcatcaattattgttgcccgtgtgcaagcacgtcgtgaatttaaataaggattagcgccatatttttcgtatggcgcttttttacgcgccaaatgatgcgattagtcggggtaaaacagttataatgaacctgaaccttaaatatttaaggttcagacaaggctacgctatgtcgattttaaggttcgatacctattatttaagacatcagagcggccaacgctcacgattattagagatatgaatgaaatccgtttgggaatatgtgaggttaacgagatggcaggaaatacaattaagttattagtagtagaagatgattttgcgttgaacgacaccgtccgtgagacaatctcagaacttggtgaagtaacgcaagtgcacgatggtgatgaaggttggttcgaaattgaatcaggtgtttatgatgctgttgtgttggatgttatgttgccaggtcaagatggctttacgattttgaagaagtcgaaaaacatgttccctaacttgccaattctaatgttgacggccaagggtgaactatcagataagatgcaaggtttcaacttgggtgcggatgagtatattaccaagccgttctacaaggaagaattgttggcgcgtttgaagacgttgttgcgtcacacaggtgtgcttggtcaagacggcgctcttgaagtaggaaatgtacaagtctttattgatcagcaccgtgtgttggttaatgaccaagaagtgaacttgcaaggtcgcgagtttggtttgttggtttatttgatgcaacacgtggggcaaatcgtcacgaaggatcaaatttttgatcgcctttggggatttgattctgatacatctttgacggttgtcgaggtgtatatgtcaaatcttcgtaagaacttgcgtaatgcggatgcgcaagtcacgattaagacgttgcgtaatgttggttatacgctaaacgcagccgtaacggaagattgattttatggtagaaaagaacaaacaacgctgggatgaacggtttgaagcacacgtccgggcgttttttgccaaaattaaactgccaaagtggctgcagagaatccgcgcctcgctgtcacaacaagttaaaatgaccatcttgatggtcgttggttttacgatggtattctcattgattgggacgtttacaatcggccaatttaggaatgtgatgtatggcacggcagagggtcgcgtggcacgtgcctttgactcgcatgcaagtcgctatgatgaaccaaccattcaaagtgcacagattaccgattatgtcgagacgtttaaagatgcattgaatatcaaacgtgagaataaggtatacctcaagtcatatcgtggcagttggtatttctttaatcgtcagggtgatcaattggcgttcgttgatgttacgacagaacatgagattgttgattcattccagaatcgtttggtttggatttttgcgttgtctgaaattgcattgttgctgatggcggttgcgttgacgcgcgccaacatgcgtccaatcatgcgtgcatggtcgcagcaacgaacgttcgttgctgacgcggcccacgaatttaagacgccgatgaccgttattcaaaataacttggagcgcatgttggaacggccaaatgatacggtgatggatcaagtcgaaaacgtcgcaaatgcgttgactgaagtgcgtcacttgaataatttgaccggtgatttactgacactatcacaggccgacgctgatgtgccgttgttcgcgtttgctgacatggacttggcgaaggtagcccgtgaagttggtgatattttcgaattcacggccgaagaaaagggtcaaacgctacgagttgatgtgcctgagacgttgccgattgtcggggatgcccaacgtttgcgtcaattgctggtcatcttgacggataacgcccaaaagtacgctggtgaaggtgctgacgtcacgatttccgcaacccaaacaaacagcagtattaagttgcaagtttcggatactggtaagggtgtgccggatgctgataaacagcgcttgttcgatcgcttttaccgtgttgataaggcacgttctcgttcgacgggtggtcacggattgggacttgcgattgccaagtgggtggtccaaggtcaccgtggcaccattgaagtgttggacaatcaaccacacggtacgatatttagtatgacgctaccaaagaatcaaaaaattaaatagtagaaggcgatgctactcgaattaggtggcatcgcttttttacagggcttatgaaagcgctttcttttcttgcttaggccacatttcggtcataaacgaaccatatactcagctttggtaattaagaaaacggagaaataaaaatgagtaagtttactgactttggttatacacaagcgcaaatcgatgaaaagttccaacaagtattggacacgatttttacaaatgaagagacaaagttctactacgacaacggtgatggtacggcatactttactgatactggtaacgatgatgtgcgtactgagggaatgtcatacgggatgatgattgctttgcaacttgatgatcaagcgatgttcaacaagttctgggcatgggtgaacaagtacatgttgatcacagacggcccaatgcacggcttcttcaagtggtcagcccaacgttcaggtgtgtctaacgctgaaggttctgcgccggacggtgaagaattctttgcggctgctttgttgatggctgctaaccgttggggtgacggcgaaggcatctttaactacacggctgaggcgaagtcattgttgcacgagatggtgcacaaggatgaagaagaaggcggtcgtggcatgttcgatcctgagacgacgtacattcgtttcgtcgcagaaatggacatttcagatccgtcatatcacttgcctcacttctacgaggtttacgcgcaatacggtaatgaagaagaccgtgcgttctttgagcgtgcagccgatgcgtcacgcgaatatttgaagaaggcgatgaacccagaaacggggatgtcagctgaatatgcgaactatgatggtacgccaaatgacttccgtggccacggttcattcttctcagatgcataccgcacagcagcgaacgttggtttggatgctgcgtggactggcaaggttgatgccgaattgactgaccgtgtcgttaagttgcaagaattctacaagggtcaaattgaacaagaaaatatcccagtttactggattgacggcacgattgtcggcgacaaggagactgaagatggtcaaagcttgttgtacgtgaagcacccagttgcattgaaggctggtatggcacaatcaacattagcaacgccaaacaatgagttgtcaaagtactatgtggatctattctggaacatgccaatgcgtgacggtgtttaccgttactacgataacttgttgtacctatttgccttcatgtctttggcgggtatgtataacaagtatgacaagcaggcatcagcagatcgtgtactagtaacaaattaatagtggtgatagtcaacctgcaatgggttggctatttttttgtaaatgtcaaacaattgcacttgcaaattaggtggcgattttgactttttgaccggataaatacgacctctgggcaaagaccccttgtagattaaaatcattccctgtattctcaaacacgtggtaatgaaaccgtttacagaaagcgtttgcattacaaatattcttaaggtagtcaccatgaacaacggagggtaatcgtcatggaacaaaagatgccgaatcaagtggggtggggcgaacgtgtctcatacgccatgtcggactttgggtgtaacactatttttcaaatcgtaggaacgtacttcttggttttctgtactgacacattgggtgttgctgcagcagccgttacaggacttttcgcgattacagcaattattgattcaatcgatggggtgatttggggacaattcatcgaccgaacacatacgaagtggggaaagtcacgtccttactggttgtggttcgcaattccatttgccatcttctgtgtgatggcctttacggcgccaccactatcagaaactggtaaggtcgtttggatttacatcgcctacatcggcgcaaagattttgtactcaggaatcaatattccggttacatcaatcttgccagcgttgacttcaaatccacaagaacgtgtgacgttgtcaacgattcgtcaattcttcggaaacatgggcgcagccattttcttgccattgacgttgccagccgttggacttatcgctggtatctttgataagggtgctaaggatccatcaacatcagcaactggttggttcatctgggccgttatcttgggtgttatcacggcagcctgcttgttggttgctttcgccggaactcgtgagcgagtggtcacaaaggactctaaccgttcaattccaatgcgcgaatcagtgaaggccttgaagggtaactacccatgggtcatcatcattttcatcaactttatctactggggtggatttgccgttcgttcaagttcattgccttactacttcaagtacgttttgcacaacgaagcgttgggaagttaggttttggccggaacggttatcacattggcctcaacagcaatggtgccattcgttgcccgccgtttgggtaagcgaaacacaatgttgctaggaatggttggtacagctttgtcacaattggttctttaccttgcggacatcatgaacggaaacgttgccattatcttgactggtatcgtcttgtacttcatcagctacggtttgacgggtgcgttgatcgccgttatgttgtcagacgccgttgatttcggtgagtggaagaacggtgtgcgtgccgaagggttcgttacatcatttagttcattctcagccaagttgggtatgggaatcggtggtatggtattggccgccgttttggcagctggtggttacgccgcttcagctgacggtacgcagaccgcatcagcattggacgctatccgcatgggattcatctggattccatttatcggttacgctgcctcagcaattgccttgttgttcaacaatatcgacaagcttgagccacaaatggtcgcagatttgacggctaagcacgaacgtgaagctgctgcagttgcagaagctgaagcctaagcagataggcatttcaaacataattaaacggggaataaaaacatgaagtttactaatggatactggctaaaccgtgatgagtacattgttaactcaccattggaagcctttgacgcaatggttgtagagaaggatgacgacaactacgcaagtgatgccttgcgtgtttactcagcctaccaccgtatcaactctcgcagtgacatgttggatgtcggtgcaacgacgatgacggtgttctcaccagccgaagatgttatcggtgttgagttgaagcacttcgatcgcgatgacaagaatccactatacgagttgcaaaacaacaacgtaacgccagcaattgaaatcgcagattctgttgcaacgttgacaagcggtgatttgcaattggctgtctcaatgcacgacaagttcaacattgatttcaactacaagggtaagcgcattacgggttctgaatacaaggcccaagcgtcaatcgatgatttgtcaggcaagcaattgggtcaagtgatgcacgccaacacggttactggtgcgcaaaacttgggaccacaaggatcagttacggcaacggaccactttatgcgtgagcaattgagcctattgccaggtacgaatgtttacggattcggtgagcgtttcggggccttcgttaagaatggtcaaagcattgatacgattaacatggacggtgggactggttcagaacaaagctacaagtcaattccgttctatatgacgggtaaggctggcgtttactacggtgttttcgttaacgaaagccaaccaacgagttttgaagtcggcagcgaagtggttgatcgtgtcagcttctcaacacgcggtgagtcattggaatactacgtgattgcaggtgattcaccaaagtcagtgatttcaaagtacaacaagttgactggtggttctgttttgccacctgaatggacatttggcttgtggctatcaacgtcatttacgacggactactcagaagaaacagttatgagtttcatcgacggtatgttcgaacgtgatattccggtttcagtattccacttcgattgcttctggatgaagggcttcgagtggtcaaacatggaatgggataaggaacaattcccagatccagttggtttgttgaagcgtttgcacgacaagggcttgaaggtctgcgtttggattaacccatacatctcacaaaagtcaccactcttcaagattggtaaggaaaagggttacttcatcaagcacactgacggcagtgtttggcaatgggatttgtggcaaccaggtaacgccgtggttgacttcacgaacccagaagcccgtgcttggtaccaaggtttgttgaagaacttgttggacatgggtgttgactgcttcaagacggacttcggtgagcgtattccaatgcacgacgccgtattctttaacggcggcaaccctgaaggtgagcacaactactacacgcaccgttacaacgacgctgtgtttgagttgttgcaacaagaaaagggtgaagacgaagcggttgtctttgctcgctctggtacggtcggtggtcaacaatacccagttcactggggtggtgacaacttgagccaattccactcaatggctgacagtcttcgtggtggtttgagcttgatgtcatcaggttacacattctggagtcacgatatcggtggcttcgaagagaatgcgagcccatcaatctacaagcgctggacgcaattcggtttgctatcaagtcactcacgttaccacggtaacatcgagtaccgtgtgccttggttgttcgacgaagaagccgttgatgtaacgcgtaagttcacgcaattgaagttggagatgatgccatacatctacggacaagctaaggaatcagttgaagctggtatcccattgatgcgtccaatgtacttggagttccctgaggaccaaaatacggcaacgttggatcgtcaatacatgcttggtagtgatgttttggtggcaccagttatgactgaagaaggggatgttgattactacttgccagctggtaagtgggagcacatcttggatggtcgcgtcgttgaagtgactgaaaacggtcgctggatgactgaaaactacgacttcatgagcttgccattgtggaagaagatcggctaaggctgacggaaagtcagaaccccaggtcaattaagaatgtgataaactgagcttatagatttcgcgagccgatgggggtcggtgcgtaaactttgaggggttcagtgatggaaaaggcagcgcaacagcacgaaatagttgcagataattcagatgttggggttcgcgtctttttatccgatgaaccgcttggatttaagccactgcattggcacacgcatattgaaattgtgctcgtcctaaccggtgaagtgacgtttcgatatgagcaacatgatgtcacgttgcatgaaaatgaattcatcgtgattggatcggggattctccactcgacaaccaatttggcaaatcaagccctcgtcttgcaagttcctgtgtattatctcaaccagtattggtcgaatagtgaattgctacgatttgatttgtggacgaaccatagtttgcatgatgagacgtacgacaagattgtcagcatgcttcagcaaatgacccaaatctatttgcgaaaagaagccggctaccggttgcgatttagcagcatattgatgcaagtcttgtacgactggattacaaactatgctgtgacgttaactccggacgacttaacagaagatgatcgtttgaaagatgtgattatgtatattcacgagcagtatcgaacgaaaatttcattgagtgaggtcgcggagaagttccactacaatcccgattatctcagtcgtgttttcaaacgacgagtcggggtaacgtttgtgaactatgtttatcaggttcgtctagatgccatctaccaagatgtgctcgcgacgaatcaggttattaagacgatctttatccgtcacggcgctagcaacacgaagttagcgatgaaaatgtttaaagaattatacggtcagacacctaatcagttacgacaactgaataaaggagactgatgtggaaacggtatcgcagagatgtgataccgtttttttgttggcactttctacttgtgttattcagaaactgatattatactttaaatagtataagaggttatgtactatacggataatgattgagatattttaagaggtggaaatcatgaagaaaatcattggtttgattgcagctgtgttggtcgtgtttggcctatacaagggatacgaatactacaacgtcacgtacaaggcaacaccagcttacgcaaaggtacctgctcaagtaccagagttgaaggacacagttgatgatgctggtaagaagattgccggatcaaagtcatactcatataagttgacgttcattacgactgatggggagcgtcgtgtcttggactacagcattgaagatgcagatccattgacaccaaatgcatatgtgaaggctgacatcagccaaaagcgtgttgtaaagggacctgaaggggtacaaaagtcagacgtgccaacgtcagtacttgaaaagttgaagtaagagagcaaacaagcgttatcacagtcagtgatgacgcttttttattttgaaaacattctgaatttaggcaatgatgcctaaagattagggcattggttgttaacgtttatttgttctactggagtataaagtgcagcagaatgattgaaaggtagggactagatgtttaaagcagagtggggatattttaaagagcataaattctatattgtcgtcatgattggcttgctagtcctgccatcaatttatgctgccgttttcctgagttcgcttgagttcgctatggaatccgtatcaaaaagtgtctgatttgcctgttgtggtggtgaataaggacaaggcgtatacagtggataagcagaaattgtctgtcggaaaagacctggcgagtgaattgaagaaatctgatgctatggactttacggttcttaatgaaaaagaggccaataagggcatttcagatggtaagtactatatgaaaattaccattccaaaagacttttcgaagaatgccacaagcttgctagcggataaaccaaagaaaatggtgttgcattctgagattagttcagggcacagttttattgccggaaagatggctgaaacagcggctgaaggtatcgtggcacaggttgctggtgaagtgactgagacctatgcaaaacagttggtgaaggctgttaagaaagttggtaccggagttaacgatgccgccaaggctaacaaagccttatcagatggatctttagagctggaagatgggaataagacgattaccacgaatctgggtacgctgactgatggcgcgacggattttgaaaatggaacaaaaacattggacgaaggtgtcacacaattgtctgatggtgcgacgaccttgactggtggggttgcgacgtacacgagtggtgtcagccaggcgtacgatggtagcaaagaggtgtcggatggtctgtcgcaacttaatgacaagctaggcacgacagcggtgaaccaagatttagctgacgttgaagcgacactgtcagacgtccaaacgaaggcagaagaattgttagccgggatgccaaagccagagcatttagaagatgcaaagcaagttgttgcacaaattaaggcgcaaaaggaaattcttgcggaagcacaaaagaatgaccaacaagaattggcgaaacttatcaatggcttgaatgagttggatgataatcaaaaacaagtggtgctccaagcgattgaaaaacagcaatcaaactcagccatgacccaaaaattaagtgcgttgcagacggattttgacaatcttgaagcaaagttgcaaccagttttggataaagcacaagaaaagctggattcagcggcgcaattgcacgacaaggttcaaacgattgcggagaatgacttagcgaacggaattggccaaatacgagaggcatcagcagccattactgaattgactgatggttcaaatcaagtgacggcggggctgggtgaattaaatcaaaattcagcgacgttgctatcaggatcacaacaacttagtggtggcctgacaaccgttaagaacaacgtacctgctttgatttcgggggcggaccaaatccgtagtgggtcttctgaattagcggatggatcgaagacgttaggcgacggacttgtccagattcagggtggtaacgcaacattggctgagaagttgggtgaggttggcaaggcaacgagtggtttccacgcaacaaaggccttgtataaccaagttgcgacaccagtgaaggctgttgaaacggaaaaggaccacgttaaaaacaacggaacgggtatgacgccatacatgttgtcggttggattgtacgtggggatgctggcgtttaatttgatgatgggaatgggtgaaccacgtaagaagcctgaatctgaattaggctggttcgcttctaagatgagtgtgttggtattctattctgttttggcggcaaccattgtgtatggcttggccgtaacagtgttggggctggacccaattcacccatgggccacatatggtatgaccgtgatgacatcactgacattcggtgccattgtcaccgcgttgaatctctggttggacaaaccaggagcattcttggcggtggtcttcttggtattgcaattgagtggttcagcaggaacctacccaattcaattaacgagcggattcttcaaatggttacacccgtacttgccaatgacatacacggttgatggtttccgtgagtcgattatgattggtgggtcggtatggccacaggttggtgtcttgctgggtatcacggccatctttacaattatcatgtacttgtattatgcagcccgcatgcgtaactttacaatgatgtcggatctcgaagaactataatgcacacaaaaaggcaacctcgtagcaagtgctataaggttgccttttcaattacaattcgtcatcggatgaatcagtataatcttctttaaaaacaagtttttgatcttttggacggccgataaagcccgtgccagttagcgtatcacttggcaaaacggacaggatgaagccgattaacgcaaaaataccaccaatcataatcgtaattcgcattgagccgttgctgtaaatgcgctcgctgtgcgagaacaatgaaagtatccaaacaagccaagcaacccaagttaccataccagcgtcgcggtaacgacgaatcgttagcgcgatatttggtaagaacatggccaaagccaataggataccaattattacaacgataaatgtgaacggtgctgaaagtagttcactcattagcttccaattttcaatgccttgtacgttaggctgactaaacttgtcgaccttactaattaggctagaatcgcttaccaaggcgataacgaataaaataagccaaacaaagaagatgatagttgaccaaagtctcatccaccagaattcggcacgagttgaacggcccgtgaagttcacatagcctttccaaaaattaataaatgcttgccacatagttaccataacaaatacctcccaagataattgtgtcatagttgatattcaaaacaaataaaaaagcctcgccttagcgagacttttgcattttctttaaatcaaaggttgtgggtgagcatcgaaaatttcaacgccgttgtcgcgaccgacaacaaccttatcaacgatgttcaaaaatagcccgtgttccacaacgccaaccatgctagtcaattcacgaccaagcgtgaatggatccgtaatatcagttgggtgcaaatcaattaagaagtttgctgagtcggtacgaacggggttgccgttttggtcaagacgccatgaaggcttgtagcccttggcttccaaacgcttgaaaagttggtcagatccataagggatgacttcaactggcaagtagtgcgttagctttggcgcaagcttaccttcatcaacaacccagatattgcgtgatgagttaatggcaacgattttttcccaaagcaaagcggccccgccacccttaatagcggcaaattcagggtcaatttcgtcggctccgtcgattgtcaggtcaatgtggtcaacgtcatcaacgttgtacatcggaatgccaagcttggctgccgtacgacgcgtcttgtctgacgttgggacgccaacaatgttaagtccttcttccgccacgcgcttgccaagggcttcgataacgtacgcgatggtagaaccagaaccgataccgacaaccatgccgtcttcgacaaattcagctgcgcgataaccggcaattttcttgagttcgtttgtatcagtcatgtggccaacttccatttcatagatttaatacttctattatcgcttataagcattgatttaagcaaatgcaaaaaacgaaggtgctaatttgttagtgaaatctgctaaactggactcattatgaaaaaagaaattgaggacgagtcatgattgacatgtgggacgaagaaaagattcgtgcgttccgtgcgacactgcttgattggtacgacgaagcaggtcgagctgacttgccatggcgcgaaaaccaagacccataccgtgtctgggtatcagaaattatgttgcagcaaacgcaggtgcaaactgtcattccgtatttcaatcggtttatgaccatgttcccaacgttgaatgatttggcagcagcgcctgagcaagatttgctgaaagcttgggaaggtcttggctattattcacgtgttcgcaacatgcaaaaagccgcgattcaagtacgtgatgattacaacggtgtctgtccggatacgatggctgaacttgaaaatctaacgggtatcggaccgtatacggcagcggctatcgctagcatttcctttaaggagccggtgccagctatcgacggtaatgcattccgcgtgtttgcgcgcctgtttaaaattgatgccgatatcgcacagccgaagacacgtaaggtgttttttgacttgggtctgcaattgattgacccagagcgtccaggtgattttaatcaagcgattatggatttagggtcatcttatatgagtgccaagaattatgattctgaacactcgccggttaagcaatttaatgctgcttatgcagatggcactgaagatttctatccggtgaagtcaaaggcgcccaagcctaagccaattacctattttgcggtggctgtgcattcaccggctggctatctatgggagcagcgtccgacgactggtttgctcgctaatttttggacgatgccactctatgcgttgacagacttcgttaccgatccggatgctgagtggtctgaggacgaaatgattgcagctactgagaaacgtttgctggcagattatggcgtagcggctgagttaactaaaatggctggtcgaccagtgacgcacgtatacacgcaccaaaaatggacggtgaccgtactgacggctgaagttgaagcaatgccattacaacgaggtacgtggcgtgaatttgacgcattgacgcgtgatccacaaccaaaaatccaagaaaaaatttggaaacgattgaattaatatgcaatattatgcagtcgtgatgtatggtattatctaatacacagactcacaaatggaacacggggaatatagacatgacacacaaaatcttgctggatatggatccaggaattgacgacgctgcagcgatttcaattgctttgaccgatgaccaattcgatgtaaaacttttgacgaccgttgcgggtaacgtcagcgctgataagacgacgcttaacgccttgaagttggtggagttcttcggtgtgcaagataaggtgccggttgcaactggggctcaaatgcctttgttgaagcactatcaggatgcgtctcacgtacacggtgcgtcagggatgcctggttgggattttgcgccagtgacgacgaagccattggcacaacatgcggttgaggcgatgcgcgatacgttgatggccagtgacgaaaagctaacccttgttgccacgggtgcgtttactaacgtggcgcacttgttccgcatgtaccctgaaacgaaagctaagattgaccgtttggttgtcatgggtggctcactttcaggcggtaacatgtctagtgtggcagaatttaatatttatacagatccacacgctgccaaaattgtattcgaagctggtttgccaattgtgatggtaggacttgatgtgacgatgaaggcattgctttcacacgaaaatatcaaaaagcttggtacgctcaacgaagcgggcgcaatgttgcaagcgttgttgggtaattatgcagatgatgaaattgagggaaagccaatgcacgatgtgaacacattgttctatttggcacacccagagtactttgaattaactgactattgggttgatgttgtgactgaaggtcccgcaatgggtgggacgattgctgacattttgcgcacgtcacacgacggacaaacaaatgtttcagtggccacggacattgatgtagcagcgtttaacgaatggtttatggcagaaattgcccgaattaagtaatgaaacaaggtgttgtgttccacgtgaaacataacaccttgttttattttcttgaactccttggaactattgattagacgggcattttgcggtattcttttattattggaatcagtttggagaatggtgatgaatcctgaagaatttgcggcggcattacgcgagcataatgttgaattgaatgcacaacaactagcgcaatatcagcaatactacgagcgtttagttgcggtgaatgaacacatgaacctaacggcaattactgaacgtgatgaagtgtacttgaagcacttctacgactctttgacgttggcctgggcatatccagaattacagacagaagagttgaacatgattgacgttggcgctggggctgggttcccatcattgccattgaagattgcatttccgcaattgcaaatcacgattattgatgccttgaacaagcgcatcaacttcttgcgtgatttggtaaaggaattgggcttggaaggcgtaacagttgaacatgctcgtgccgaagaattcggtaacaagacggcgccagctcgtgagcaatatgatgttgcgactgcccgtgctttggctcgtttgaatgtcttgggggagttgacgttgccattcgttaaggttggtggcgtgttgttggctatgaagggaagcgctgctgatgaagaattggcagaagctaagaaggccatcacaactttgggggctgagattggcgaccaaatcgacgtgagtctaccaaatggtgatccacgttcggttatcgtgattaagaaagtaaagaacacaccaaaaaagtatccgcgcaagcctggtgatccagtgcgcaagccgttgtagaaaggggaaaacaatgggacacattattgcattagctaaccaaaagggtggtgtcggtaaaacgaccacgacggttaacttgggcgcatccctagcatccctaggtaagaaagtgttgttgatcgacactgatgcacaaggaaacgccacatcaggttcaggcgtgcaaaagtcaagtattgaacgcgatgtgtacgacgtattggttcacgatgtgccattggccgacgtgattatgccaacgtcacacgagggcatggacattgtgccagccacgattcgcttggccggtgctgaacttgaattggcaccagcgatggcgcgtgagttgcgcttgaagaatgccttggaaggtgttcgtgaaaagtacgactacatcctaatcgacaatccaccttcacttggattggtgacaattaacacgttctcagcagcggactcaattttgattccagtgcaagctgaatactacgcccttgaaggtttaggacagttgatgaacaacatgaagttggttaagcaacacttcaacccagacttggaagttgagggtgtgttgatgacgatggttgatcctcgtaccaacttgtcatcagatgttattcaaaatgtgcgtgagtacttcggtagcgatgtgtacgacacggttattccgcgtaacgtgcgtttgtcagaagcgccatcacgtggattggcaatcattgactatgattcaaagtcaaagggagccgaagtttatatggacttggcaaaggaggtcttggcagctcatggcgaacactaagaagtcaggtttgggtggccttggtggcaacggtggcggtctaggcgctttgtttgctgaacaaggtcttgatacagaaattgcaacgactgatacggttcgtgatattgcaatcgacaagattgtggcgaacccattccaaccacgtcatgtctttgatcaagatgctttgcaagatttggcagcatcaatcaaggaaaacggcgtgttgcaaccagtgattgtgcgtcacaaccctaaggacaacacgcaatacgagttgttggccggtgagcgtcgttggcgtgcctcacaattggcgggcaagaaggacgtaccggcgattgttcgtaagttagacgacgaacaaatgatgcaagccgctatcttggaaaacttgcaacgcgaagacttgacgccacttgaagaggcacaagcttatcgcgacatgatggatgcgttgaagttgacgcaagaacaagtggccaagcgccttggtaaggctcgctcagccgtggctaacttccttcgtttgcttaacttgcctgacgaagtgaaggatatgttgcaagctggtcaactatcaatgggacaagcgcgtacgttgctcggattgcgcaacaagcgtcgcattgtgccagttgccaagcgtgcaattgctgaaagcatgacggttcgtcaacttgaacaattggttaacaagttgaacgaacaagctgacactactggtaagggtaacgacgaaccatctgcttatttgaaggcaacgacggctgctttggaagataagtttgggacgaaggtcaacgtcacccgtaatcgtaagggtgctggtaaaattgaaattgcatacttgtctgatgatgatttgaaccgcatctttgatgtattgggcatttcatttgacgaggaataatctggaggttggttatgtacaacttgcatgatgtagttgagatgaagaagccacatgcgtgtggtgcgaatgaatgggaaatcaaccgtattggtgccgacattaagttgacgtgccaaggttgtggtcaccaagtaatgatgacgcgtcatgatttcgataagcgtttgaagcgcattttgcgttcagcgtcagaacaagattaatagagagataggtatttaaaaatggctcttacagcaggaatcgttggtttgccaaacgttggtaagtcaactttgtttaacgcaattactaaggcgggtgccgaaattgctaactacccatttgccacgattgaaccaaacgtgggaatggttgaagtgccagatgatcgtttggcccgtattcaagaattggtgccagctgacaagatcgtgccaacgaccttcgaatttactgacattgccggtatcgttaagggtgcctcaaagggtgaaggattgggaaacaagttccttgaaaacatccgtcaagtaaacgccatcgtgcacgtggttcgtgcctttgacgatgatgacatcactcacgttaacggtaaggttgacccaattgatgacatcaacacaatcaacttggagttggttttggctgacttggaagccgttgaaaagcgttacgcaacaacggaaaagaaggctaagcaagcaaaggacaaggatgctgctgcagaatttgaagtgcttgctaagttgaagccagttttggaagaaggaaagcctgctcgttcaattgattggaacgaagatgagcaaaagattgtgcgtggcttcttcttgttgacgtcaaagccagttttgtacgtggctaacgttgctgaagatgacatgacagatccagaagcatcaaagtacttccaacaaatcaaggaatacgctgcagccgaaaacgctgatgttatcggaatttcagcccgtgccgaagaagaattggccggtatggatgacgaagacaaggctgaattgatggaattgcaaggtattacggaaccaggtttgaaccgtttgattcgttcagcctaccacttgttggacttgcgtacgttctttaccgctggtggtaaggaaacgcgtgcatggacgttccgtgcaggtatgaaggcaccacaagttgccggtgttatccactcagactttgagcgtggatttatccgtgccgaaacggttgcctttgctgatttggacgaatacggttcaatgaaggcagttaaggaagctggacgtcgtcgttcagaaggtaaggagtatgttgtccaagacggtgatatcatcgaattcttgttcaacgtttaatcgggggaactcatgacagaatcacaagaacaaacggtaacgcctacgctaccatcacgtgccgacttggccacgtctggtttgacgaagcgtaatcaagattttatttggcaaatggtacaacttgttgaaggcgacgaaagcaaggcaaccttgattgctgaagttggcgcaaagttgttggacggtcaaaagactggtacgacagcgcgtcaattgtttaacacacctgctgaagcgttggggcgcaaggcaaacgcaactgaagcaacgccagcacctggctacgcaacatacggcttctggccattgttggttgataacgcgattgccttcttcatgatgttcagctttatgtttggattgacgttgttatttagcaaggcatcacaaactggtagtgccggtgcagccggaattacctcattggttttgacatcattgttgggtggattcttcttcgccgttgttacaatgacgttggcaccaaagaaggacggttcaaagacaccagtactattgaagattttgatttcagtcggtgcctttgtattgtggttcttggcatacttgggcttcagctacttgccagctgttatcaacccattgttgccaggttggttgtacctagtattcgccgtaatcgcctttatcgggttccgcttctggcgtgttaagacgggtatccaaggtggattcctcggtggtagcacacgtcgtccacaaaccaagtaagcaactagaattagtgaggatgaatcgatgaaaattttgattgttgatgatgatcacgaaattgctgaattgcttgaaatctacgtgaagaacgaaggttacgagccagttattgccagcgatggtaaggaagcaatgacgaagatccgtacgaacccagacatcggtttggttattttggacatcatgatgcctgaaatgaacggtacggaagtgttgaaggaagttcgtaaggacaatcctgtaccaattttgttgttgtcagccaagtctggtgcaatggacaagattcaagggttgattacgggtgccgacgactacgtgacgaagccatttaacccattggaagtgatggcacgtgtgcgtgctttgctacgtcgtgcccaaaacggtatggcgcaagcaacaccagaagtgcttgatatcggtcctttgacgattaacaaggacagccacgaagttaagacagccgacggtgttgaagttaatttgacggcgttggagttcggaattttgtatttgttggcttcacacccaaaccgtgtgtttagtgctgacgatatcttcgaacgcgtttggcaacaagaatcagttgtgtctgctaagacagttatggtgcacgtttcacacttgcgcgataagttggaagccgcaactggtggtaaccaagttgttcaaactgtttggggtgttggttataagattgaagtgctataagcaccgcgtatagaaagaggaagtagggatgaaacttagtgtactggattggctgttgttagtagtcaaggcagtcgtttcggccctgctttttgtgtttactgggattggcatcctattggcgatgcgttcaaactggcatacagcaaactggttgcttgaaattcaggctatctggcgccaagatacgacgttggcagttgtggtcgctattgtggtgattgcactctggggtgtggtggttcatttcttttatgaacagattgttttaacgcacctgattgatagcgtgagtgaattggcaccacgcgtgcgtgatgctaacgctactggtttgtcggaaacgcgaatgagtcgtcgtttgcgcccgctcgccactaatgtgaatggcgtgtttgatgccgcacaaaaagcaatggccgaggaacgtgaaattgagcgttctaaggatgaaatgataactaatgtgtcgcacgatttgcgtacgccgttgacgtcaatcttgggttatttgggattgattgtgaatgacgaacaaggcaacttatcacgtgctgacatgacgaaatatgcaacgacggcctttgataaggctggacaaatgaagtcgctggttgaagatttgtttgattacacgcaagttcgccaagttgatttcaagttgcgctgggcaccgcttgatttggcggccatgttgcaacaattggcggtaaactatgagttggaagccaagaataaacacgtggttgtgtcagccgtgacgaatcctaacagcattgaaatggttggagatccggatcgtttggcgcgtgttttcatgaatttgattagtaatgcattgaagtatggggatggggcaacgtttgtacgtttgtcagctaaaactttcccatctgaaaatattgctgagattcgtgtgacgaataatggtgaaaagattccagaagaatcaatcaagcgcttgtttgatcgcttttaccgcgttgaaagctcacgtaacacaaagactggtggcactggtctggggcttgcaatcgtaaatggtgtgattgaagcgcacggtggtacagtacgagttgaatcgaatgatgatttgacaagttttattattcgactaccattacaaccagagggacttgatgacgaaggagcgtaatgtgaagatgagaaaatggttaacaggtttgttaatgacggtggtgttggcatttggtgttgcaacaccaagttatgccgcgatcgtaacgccaacagttgatgctcaggcagcggctgttgtggatgtgcaaaccggccaagttctcgcggataaaaacggcaacaagcgcattccaattgcatcaatatctaaattgttgacggtttacttggtagaacgggcgattgaagcaggtaagttgacaatggacacgcctgtttcagtgcctgcgtcaattgtggcgattagtactgaacctgggttggccaacgtgccgttgagtacagagcgtacgtatacggtgcgtgaattgacggaaatggcgctgattaagtcggctaatgccgcggcattagcccttggttacgcggtttcgggtacgccgacgggggtcaatcaggaaattcaagacttgttgacgagttggggcatcgacgatacgacgattgtcagtggcgctggtctaactaacggtgatatgggagcattgaagaacccaaatcttggtgatgacgtggaaaacgaattgtcggcgcgtgaattagcgattgtcggccgccacttggttgaagattatccaaatatcactgaaattacgagtatgacgtcagcagttgtgcctagtggggcgactgggactgaaacgataaagaattcaaattcgttattgacggatggccacggttacgacttcaaaggcttgaagacgggatacgcgctatcagttcacagcacctttattggtttaacgaagttggccaatcgcgatgtgattaccgttgtgcttggaagtgatcacacatttacgcaaacggccgcgatgctgggccaagtgaaggcagctacgcaggttgttacccttaagaagggcacgcaaatgcagcgtgtgccggttgaggaggccaaagatggtcaccgtcgttatccgctggtaacgaacaagacagtgacgctctttgcaccgaaggcttgggataaagctaaggtgaatatgacgattcgttcaaaccacgatatgattgcaccgatttcaaagggtcacgttgttgatcacaatgaaaacctgtttgttgatggtggtacaaaggcggaagtccgtgcagcaaatgattttgttgacggctttccgaaggttaatttgattatgaacgaggatgtcgaacaagcgtcaacgcttgttcaatggtaccgtgacgccaagcgcgttatttcaaatttgtttgattaagtaaaaaatgacctgacgccgtttggcatcaggtcatttttagtttactccgcgtccgtgtttgcttcttcttcagcaacggcagcttcgtattgcaacaaacgttctgagacgtccattacaacgttatcttcatctcggatctcaacaatcaatcccttacccaaccatgagtggtcaccagaatatggcatttccatttcttgttggaaatcaccgtcgtgttgacggaacaagacaccaaccgcttcatccgtgtagtcatccgcaaaccaaatctcaacaactggtgcaacgatggccttgtaggtcatcatcgtatcaaagataccccagactgcagtttgcgcttcctcaggcatacgcttggcaagttcttcagtaacaacgcgtgacttagtagattcaaacataatatttagttcctcactctagatgtggtaaaattaattcatctaatagtataccacggaaggacaatgagctaacatgaacgaatatatgacatggcgtgaaggcctaaaggatgttgaattcccacactgggaggatttgccagcatttgatctttacatggatcaagtcgttgagtatgtgaataacgttttggcaccacttaacatgccaatggtgacgtcaacgatgattaacaactacgttaagcaaaaggtcatcatgtcaccaatcaagaagaagtaccaagcgatgcaaattgccgatatcttgattatttctttgatgaagcctgtcttttcacttgatgaaatccgtgcggctatcgatcaagttacggttggcgattatccaaagaaggcctacaatgcctttgtggatgcgttggcagctcgtttgcaaggccctgtgccagttgaattcgaccccgatcacttggatttgcaactcatgcgcgatgcagccaatgttgtcttccacaagatggaagccgaaaagttgcttgagttgatgcgtaagcgcaacccaatcaaggaagttccaacaactaagtagtaaaatgagacacgcttaacggcgtgtttttttatttttgaaactatttccccagttcgtgcgtctaattagtgtaagcagataggaggacgcgacatgcgtgaagaattaattgcaacgctacatgagaataaagtcgcgttgtaccgtgtagcgctgagttatgttcacacagaggctgaagcgttagatattgtacaggcgactgctgaaaaagcgttgcgtcaggtgggtcaggtgcaggagccgcgctatttgaaaacgtggctattccgcattttgattaacaccgcgattgatgtgcaacgcaagcaagcacgtcgcaacgaaattggcgatgaatcacttgaatttatgccagcgttaacaacgcttgcgcctgaaatgcgattggcgcttaatgatgcggttgcggatttgggcgctaaagaacaagcgattattcggctacatttctttgaggatcaaacgtttgctgacattgcattaacgcttgaattatcagaaaacacggttaaaacgacctattatcgtagcttgaaaaagttagaagcagccttgaacgggggaatgtaagatgacactagaagatgtaaagacggcctatgatggccaagatgtaccaatggataagttgtcagccgtaattgatcaagccgttgtgaagacggcacctaagcgcaagcacttgaattggtggcaaacgtcactgattggtgttggtgcggtggcggcagcgtttacgttggcggtgaacacctcatattcatttgcgagcgctgctgaacgtatgccagttgtccgcgatgcggtgaaggtggtgctgttccgtgagtataagcatgttgataagacgtcatatgcggatattaaggtgccactattgagttatttggcgaatacggatttggaagacaagctaaatgcttcgtatgctagtgaaggtcgcgcattgtatgatgccttcatgaataagacggacgatacacccaagtcactgacgcagacttatcaagagaaggtgaataacgaccagttgttagtactcgagcgacgccaagacatgtcgatggccgatacagcaagcaagttgagttacacgacgattgataagcaacgcgggttggtgctaacgttgcctatgttgttcaagtcggctgattaccaaacggtgttgcgcgactatgtgaacacgcaaattaaggcgtcagataagtacaatacgccggttgaagccatttcgaagacgcaaacgttctatattaacgaacaccatcagctggtattggttttccaacgtggtgatatcgcgccaatgtatgttggcccagttgaaatgacgattccaaccaatctaattgataaccaattggtatcgcatgaatatgtgaagtaatacaatctaattgaaatctaataaaaccgctgttttgggtataaacagcggtttctttgtgttatgctagtgagattagtttagatagtaaagggggtcaacgagatgcaagacttcatggcgttggatcgtaatcttaagttgcgatcattaacggttttcctaactgtgcttttgggaagttcaattgggccgaacgtgaccgtgtattatgtggaatattttggcgcgtttatcacgggattcttattgattgcggtatcggttgctggttttattgctggcttgtacggtggtcacttggccgatgtgctaggtcgtaagaaaacgatgctaattggatcggcgatgattatcggtggatacgcattggcaatgctgatgaattcaccatggtacaccaatccgtatgtgacgttcgttgggtttttgacggcgtcagtcggggcatcgtttgctgacccggctgaacaggcgatgatgattgactcatcaacgatgaagaatcgtaaattcgtcttcgcattgatttattggattatcaatatcggtgtgatgattggtgcagccattggtggttggttcttccgagattacttgtttgagttgttgatgggctcaatgattgtcggcattatcaatgcttcgattattaattgggggatggcggaaacgcttgatatggctaacgttaaggcaaattcatctgtttggagcgccgttaagtcatacgcgcatgtgctgactgataagcgttacttgttgttcatgtttggaacgatttttgccgtcgtgatttactcacaacctgatttctatttggcagcgcacttggctgaatcattccgtgactacacactattcggcgtgcatttctatggacaacgtatgctgtcattcatgttggtgattaatacagttgtgattgtgttgacgatgtcggcatttaaccacatgacaaaccgttggccactgattcggggctatgcgattggaacgtttatgcaagggcttggttttgcaatggcattcttgttgcgtgatttctggccgttggcattcgcggcggttgtcttcacggttggtgaaatgattaatgtgccatcaagtcagacattgcgtgcggatatgatgaatccagaaaagttgggtgcctattcaggtgcttttgcggcgacgcgtccattgggaaacattatggccggggtgatggtgtcagcatcacacttcgtcggtagtgttggggcagccgttatgctcatgatcggcgtctttattgcgatttactcggttgccacagcagctaaaatgaaagcatcattttaaaaacaaaaaactccgaaggttatccttcggagttttttgagctttcatgcttatcatcttttttgtttttatcatcaacggttgatgtcttagtgtcggacttttcagattgactgtcggccatcttagcaacactgctgttagcggcggagatcgcgttattggctgaatcttgggcagctttgacagaatcactggcgactgattgtacttgagccagttccgatgtctttttggcaagtgccttttttaaggtagaaactttatcagacttctcgtcggccgtcttaagggcattaacgtatgtttcgccactctttgcagctttgtttagcaaatcaacgccatcattggtttctaaaacgcgactgtataggttgagggcagatggccagttgtcggcctgaatttctttatcagcgcgctcaagataattgagttgctcaagcgcggtgcggttttcaattgaaacatgtactttgcgagcagctttgtagtagacggccgcgtcagaccattcatgggcagcgaccgcttcacgagcggattgcatattacgttggtacgttttgttgtcgttgaatacatcgacaccccagtaactggcggctgcaattgcggtcagtgacagtagggtaatgatggtccatttgattttcatgaggcctccttattacagaacgcctactattgtaccggagtattgaaaacaggactaatatgaattttgaatcattcgttagattctgtagacaacaaaaaagccgacaagcgtaatcgctcatcgacttcgtttagctgggatagctggattcgaaccagcgatacacggtaccaaaaaccgatgccttaccacttggccatatcccaattcagaacgtgcagccaatgtacaagcaatacgcatgattgcttcattttggtttgatgatgtcccggtagaaagtagaaattggctggactttatgaactatcttggcttgcaatcgcactttgaagatatggcccgtgaagcggttatgcaagcatgaaagcgaggtattcgtttgctacgtacaattttaatcattgtcaacacattactattgctaatctctatatctctatatgcttactttaagttgaaagaagcttattttaaatacgtagctgcttcattgatagttggtttcgcaatagttgattttatctatctttacttctttaaaaattggacgtagtaactacgttatttagaaaggagttattaatatgagattgtggcacgaatctttaatcccaaaactccctcgtcagcaattgctggggcaacatagagagtgttgtgcacttcgtggcggtggttggggcaagaagcatgcaactgtaaattacgtcttcgaccactcaccatacaaattatttcaatatcaccaattagtaatgaatgagatgttaagtcgcgggtataaacctaacgaattatggttagaccccttgtaccgtggatccagggaagattcttatatttcactaccaagtgaagttctgacttcgccgatttaccccgagcatgacaacgcctatttaaaagagtgtattgaaaacttaaaagaaaaaggcattgagatagattaaaaagccacccttaaggtggcatacatacgtgcagataggagttacgttaaaagctaaggagtatgtttgtttatggactcaaaaaagttgaaaaatttagctagtgtaaacgggattgtcggtttaggcggtggaatttttctattgttcgctacgcccatcactgtatcagccactttgaaccaaagtatgatggcagcaaatctcgctgtctcagcatttttcatgattaaagtagctatttttgttcttgggattgtgggagtagtaaagtttaaaaaatctccagtagtttcctattcacctagcgttttaatgatggttggtggatcaattgctattattcccttgttggagtggattggcggaattcttgccatcatcggtggttctttatttctatcatctattaaaaaatttgatagcgttgaagcagaagactaaaaggaactaacttcctaaacaggaagttcttttttgacagtcgattgtgattgatcaacacacgtgcagataggattcacgttaaaagctcaggagaagtacaaacatggaagataaaaaatcactacttcttattgctcgcatcgctagtgtgatgtctgtactgatgtacgtttcatatatcccacaaatcgtggataatctatctggtcacgcaggtgatccaatacagccctttgtagctatgttaaattgtatcttgtggactattcacggattgtttgggacggacggtcatacccgtgacatgccaatcgtaattgcaaatgtgcccggtattttatttggattcgcagcttttatcactgcgattatctaattgtgagtatgcgtacctacccgcccagcgggatacataaaaacccaccccttaaggtggcatacatacgtgcagataggaatcacgttaaaagctttagggagtatttagttatgggactatttgatggattaatgggtaacgcgacaaaggtatcaaatgattctgttcgtgcggaaattgagccactattgatttcaggtgaagtaatcgagcactcttacaagcttgttcgagacttggtaatctttactgataagcgactaatcatcgttgataagcaaggtttgactgctaccaaggttgaatataagtcaatcatttaccgttcaattgctaaatttgctactgaaactgccggacacttcgacttggatggtgaaatcaaaatttggatttcaggacaagttgaaccatctgaagtattgcaattcaagaagggcgaagctttatcagacattcaacgattgttggctgagaaggttttgtaagaggaatcctccctgcatcgcagggatacataaaaagccccactcgattgagtgaggcgagaaaggaaattaaatgttcaacggaaccacaaaagaaatcatcttccctagctcgttatactcatccccatcttcaattaacaacttgttacggcagtttaattcactctctatacacgacgataatgttatatttgatacttcgaatatcaagtggatagacagtgaagtttcagctttcatcggagcgttaattgaaaatctaaaaattcggcaaccaacaaccaaattatttttaaaacacaacacttccccatccaggtcagaagagttgttatctaagaataattttctaaatcattatttagacaaaaatctgtacgactacaatagcactggatacacggttaaatacgatgttctaactgtaactagaaatgctttaacaaaaaatgatttaaccaatatctatgcgtatttgaataatgaattattttcacattcaaaatggggcgctaattttgaaacctacaaaaatcagctaggctttagtgagtcaattttcgaactcgccagaaatacttcagatcattctaggtcagaaaatttaatattcgctggccagtattatccaaccaagaatcagtttagattatcgatcgcagataatgggcttggaattccgctcacagttcgtgcgggaagcaatgctacgggttcggatgccgaactgattaattgggccgtacaaaaaggtaatacttctaaatctaataatcatgcaagaggaatgggattagcaactatagctaaatctctacagaacgtgggcgagctaacgattatttccgggaacggccattggaagcagatcgataacggtacagtagaacttacaaccctgtcacataaatttgcaggtacgtacgtccgaatcacatttttgaatgataaaattaataataacagcttttctagtgaagaatcgttctctgccaacttacccttttagaatacgaggttagtaaaatggaaaaaataattaatgttgcagatgtgattgacggcaaactagccgtaacgtctgacgacgcaattgtcgtatttaacatcttgaagcataacattgaagaaaacgtcatttctgttctcgatttcacgggaatcagcacattaaccacttcatttctcaacgaatcaattggtaccctgtataatgttgcgaatgcccaaaccatcgcaagtcttgtcaaagtaaacccaaaatctttacgcccaatacaatatagaaatattctctctgttattgagaacgcaaaacaaaagcaggaggagaattgatgacagctcccatgactttcctagctttagaccatctaaaaaaggcaaaaccaatattggtagatactaacatactatatgcatggatgccgattccgggagagcagcccaattcatcagttccaggtgatgtactggcagagattgtttcaaaaggtgtgccagttctcatcaatagtcacgttttatccgaatacattaatctatatgttagaaattacgcacacgctcacaaatccgagctaaatggtgacttaaacacgaattatggatataaacataattttagaaatacagatatttatgaaagattaatccaaaatgcagtagaagtaatatacgattttttagataatcaaggattagacattatttattcagatactaaagacaatctaaccaaagaggcattaacaattatgactcaatcaagagtagactttaccgatgctgtgctgtttttaatagccctccagcatggggcttctattcttacaaacgattctgatttatcaaaactagatatacctggaattagtgcaccgtcaattttgacggctcaataaaaaagcacgcacaccctccatcgccaaacttgaggtgcacgtgctatccacaaaaacaaaacattactgccctgtttccgtatttaattgtaccagacctgggcatgtctttaaactgcctaaattttttatgtaaaggttaggtttaaactaatggcagtatataaaaccgaacacggttggcgtgttgaaatatcattcaaagacacaaccggaaaatatcgtaaaaaaggtaagcgtggtttcaagaccaaaaaggaagctgaagcttgggcggctgaatattcagttgctaatagcaagccaacacttcaaaaaggcacacttacccttttcagcgattatttcgacgagtatcaacaattacggttcgatgctggtctcaaggaaacaacaaaagaatcatggcatgcagttcgcaaatacgttgttgatgtgtattttaagaatgtaacactagatcagattactcgccaaatgtatcaagcattcttgaacgattattcaagcgacaagaaacgtaaatctgtacttaagcgtcaccagattatgaaacaagtaatcgaacaagcatttcacgatggtttaataccatctgaccccacctatggcgttattataccaggcgctgattccaagtctgcggatgaaaaattccttcaagttgatgagtttaaccagctacttaaatacatcgaaactaacgacaagctaattaagtggaacacgtcattcatgatttatttgattgcattgtcaggtctgcgtgcgggtgaagcattagcacttactcgtgatgatattgatattgatgcgcacaatatcagcgtaacaaagaccaagcaacgttctggcgaatcaaccacaccaaaaacaaaatcatctattcgcactattgctatgccagatcgtttctttgataactacgaaacgtttattagtgcaaagtctgaatggaacgatgccaatgaattattcgatggccgccgttgggctactatcaataaccactggcttgaacgaattgaacgtgaacttggttttgaaaatatagtttccgttcatggcttacgtcactcgcacgtttcttacttactatcgaaaggcgtcgacattaattatgcatctaagcgtttaggccattcaaacgttacaattacgcaacaagtatatgcccacctgctacgtgacaagcaacaaagcgaagaagcaaagacgcttaatattcttggtaaaatcgactgatttttggcgcaaatatggcgcaaatttttttaaaaacacctattttggcgcaaattggcgcaaattttttgatacttttgcacactttcagacatttgaaaatagatatgaaaaaccgccagaaaccagtcatatcaaaggtttccagcggtatatcaacgtttgtatttagcttatggccacaaacggttcattgtacgtgggaatgggattgcctcacggatgtgctcctcacctgtaatccaagtaacggcacgctccaacccaagaccgaatcctgagtgaggtactgaaccatacttacgcaagtccaagtaccatgagtattccttcaagtccaaaccttgttccttgatacgttgctcaaggtaatcgtagtctgtatcacgttctgaaccaccgatgatttcaccgtatccctcaggtgccaacaagtcggctgagataacgacatcatcgcgatctgggtggcgcttcatgtagaaggccttgatttccttagggaagttcgtgatgaagacaggcttagcaaagtggtttgccaagaacgtctcttcaggtgaaccgaaatcagcaccccattcaacatcaaagtcgttctcttgcaacaacttgatagcatcatcgtatgagaaacgtgggtatggcaattgcgtgtatgacttcaacaattccttgtcacgtcccaacaagtccaattcgtactcgttacgatccaaaacagcttgaatcaagtaagcgatgtaacgctcttgcacttcaagtgattgttcttggtgcatccaagccatttctggctcaatcatccagaactcagtcaagtgacgacgtgtctttgacttttcagcacggaaagttggtccgaacgtgaagacacgtccaaaggccattgccccagcttcagcatacaattggccagtttgtgacatgtaggcatcagtatcgaagtattccgtgtggaacaattcagtcgttccttcaggagctgaacccgtcaaaattggtgaatcaatcttaacgaatccttccttgttaaagaactcgtacgttgcagcaataatcgtgttacgaatacgcaaaacagcgaatggttggatgtggcgcaagtacaagtgacggtgatccatcaagaaatccgtaccgtgctcctttggcgtaattgggtaaccttctgactccccaacaaccgtcaaatccttaacttgcatttcgtatccgaatggtgaacgctcgtcttcacgaatcgtaccaatcaagtacatgctcgtttcttgcgtcaaagccttggccttggcaaagatttcttcaccaacggcttcctttgaaacaaccccttggaaaaaggccgtaccgtcacgcaattgcaagaattgcatctttcctgaaccacgcttgttacgcaaccaagcgcccaatcgaacctcttggccgacgtagttcttcgcgtcttcaatgcgaattgtatccatcttctaaactcccttagatgtgtaatctcttataaatgttggatggtccgaactgccttaccatccgcaaattgataggtgataaagttcaaattgccttgtcgatctataaacgtgacttcccacacaggaacttgcttatagattgccaacccgaggcttgtaattcgctttgggttgtactttgacttcacaagttgtcgcacctcagcagccgaaacaccatcagccattttaacggtgacgagtttctttgactttccttttacgataacaccaattttttggtgcttcttgttctcaccaaccacactgtagtacgtgtcgttacgagaaaccgcgtaaaattgggttgctgaggtgatcttatttcgcttaaccgccaattcagtcactcgttcacgcgccgcagtaaccgggtgcattgcaaccgacacaatcgtagcaccactaatgagtagtactaacacaacgattaagccaattagccagcgccatccgtgccggcgacgtcttgaacgagcggttgatcgcatttccatgtgtcgtggctccttctggttagttctgcgtgaacagaacaaaatcaattattactgtatcaaattttacagcaatattaaagaccttgcgttaatgcgcatcaaaaaatcgcttcacctttgggacaacttcattatcagccaacgtatattgtggcatttcctccggcaacatattgcgcaacgtctttccgtaagacttcgtcaagatacgtgggtcataaatcaccacagcaccaaaatcatccggcttgcgaatcaaacgaccaacaccttggcgcaaacgtagcactgcctttggcaacgtgctttgatagaacggttgcttaccgtgtgccatcaagaccgcttcttcagcgcgagctagcacgctatttggttggtcaaatggtagtcgcgcaatcacgaccatccggagttgatcaccaggcaagtcgacaccttcccaaaaactattggcacccaaaacaaccatatgtgattcgttttgcaggcgcttcataattttgctgcgcgtccccgtcacaccttgtgccaacaacgtcatatttccttgctgccaagtttgatttgactgcatgtgattatagacttgctgaatggtgtctaacgaattaaacagcaccagcgtgttttcttgaaccgtcgtcgtcaattgcaccaattgcttggccaaatagctgacgtaccctgaatcagttggagacggcgcattctcaaccattaccaattcagcttgattcttaaaatcaaacacttcagggtaacgacgagcaaataccgtatcacgatcaatattcaaacgatcatatagataacctgacttcgttgatgtaaacaacgttgccccgacaatggttggtggcataaagtgcggataaaccttgtctttgaagaaatccaaggtgtgtagcaacccaccactcaaacgcaagttgctgctgtcatggttttgattttccgttagccagaagacactcgcatctgggaaatcaaccaaatcttgttggaacgtcgtcaagcgttgctcatacttcgcaatactctctagcaaacgacggaaatccgccaaatgttgacgctcattcaatgaaaatgcgtccttggtattactgaattgctccaacaaataatccatcgattcgcccaaatcacggactgcatggcgcatactcgttaggtggtgtccctggtcgacccagaactgtgccaactcagaaatcggtagttccacttcgtagtgaccttccgtcgctggtgtatgcccattgagcaagaaacgacgatagaacgcaacttgtagctttggtaactcacttgagagcacttccaattgctgcaagaaacgagacttcaattgttgcccaccgactaagcgattcaaaatcaccccaattgagggatcgttatcacgcaaaatcaaattcgtcgcgttttgaacacgcgtcaaccaaacttggaatggcaattggtgacggctttgttctagaacggcatttggcaagttctgggcttcgtcaatcaccaagtatggtgaatcttcagtcgttcccagctcttgggcatattcagccaagtacgcatgattaacaaccaagaattgtgcattctcagccaagacatgctgacgttcgctaaattcgtgtccgtagtaaggtgacccagctggattattggccggctgtgacaacttagccataaagtctggctgcggattaatcaaattcaattcgtcaaaatcaccgctcaaggtttcagttagccaaaccaagatttgtgccttgataaattgcaatgacgttgatccttcgtcgacgcgcaaagcacgcttgaagctttgcaaattcaagtagtgcgtacgtcccttcaggctcgccccacgtacttcaaatggcaaaatgtccttcaacgtcgtattaatcgtatcggtcacttgttgctgcaacgtaattgttggcacagcaacaactacttgcttctgttgctcatccgctagataagcatatggcaacaagtaagccaacgtctttcccattcccgttggtgcctcagcaacaaatgccgtcttaccaggctcggttgataactcagcttctgtgtaatgcgtgtaaattgcattcatcaactttgcttgttgctcacggtaagcaagttccttgccatacaactgttcttttgcagcttttttagctgggaaagccggtgcatgtcctgtaaccaacggtgccggatcagagaaacggcgcagtgccaatccatcaatcacttgcaagtgcgctggtaatggttgtggctgggcttgattcttggccaaagccttttcaaatactgtcttcgtggcacgtggcaaaaccagtggcaaatccgccaacgtttgtagggtcaacattggcaacccttcagcccgattcaaaatcgcaataagcaaatcagctgttgccaacgcatcactgtccgcttggtgcgggtgactgtgttccagcgctaggtagttggtcatatcaaccaaacgatatcctggcgcagttggccacaaaatttgacttaacggcaccgtatccaaagcagtactcttcaatcctgttaatcccacacgctcaaattcagcgttcaaaaacggcaaatcaaagttaacgttgtgggcaacaaaaattgtgccttgtagcatggcatgtagcgtcatggcgacgtcctcaaaaaaaggcgcccccttcaccatactttgtgtaatacccgttaattgggtaatgttacgtggaatttgctcgccagggttaaccaacgttgagaattggttaatgacttttttattttgtacgaatgcgaccgcaatctgaatgattcggcccgattcgctcgttgtacgggttgtctctagatcgacaaccgcatagatgtctcgatttagcatcagagcgtaccacgaccttcttttagtagtaccttaattgtatcatgaattcctcacatttatttccctaatataatgggttttggtatgataatagcagtttgaaaaaacaattagagaatggattggtgattttacagtggaaaagctagcaactggtactagccacgccaaggtgattttacttggtgaacacgcggtcgtttacggccaacctgccattgccttacccctaccggatttggccatgacagctacaatcgaggctcgtgaagaaggacaaattgtaatcgctcaagggtatcaaggccctctagcgaccatggcagaagtatatgaaggcgtacgacaattgattgtccgtttgctccgtcacttcaacgctatcaagacgccttttaccttgcgtatccagtcaagcattccacaagaacgtggtatggggtcttctgcggcctcagcgatcgccattgtgcgtgctttctttgcgttcttcgagacagaattaagcgatgctgaactacaacgctgggccaacattgaggaagccatcacacacggctcaccatctggtattgatgctgcgacaaccgcgcacgatgtaccggtatggttcgtaaagggcgaaaagcctgagccaatgtcaatggcgcttcacgggacattaatcattgccgacactggcgtacatggccaaactggccttgccgtctcagttgtccgtgagcaacttgataacgaacccgaagcaacgcgtccgcacatcgacgcactaggtcaaatcgctcgtgaaacccgcgaagacctagctaatgacgatattcaatcattgggtcgtcacatgaacgacgcccaatctcacttgtcagctttaggtgtttctcacccaaagcttgatgaattaatcaacgctgccaatcaagctggtgcccttggcgctaagttaactggtggtggtgttggcggtgctatgctcgcccttgcgcaaagcgatgaagatgtacaacgcatcatccaagcgcttgaagcggctggcgcacaagaagtttgggctcaacgttacccacaaatgtaggagataactcatcatgatgcatgtaactgcccgcgcgcacacaaatattgcgttgctaaagtactggggtaagcaaaacgaaaaacttatcatgccaactacgacctctgtgtcactcacgttggatgaattttatactgatacaacagtctggtttgacgatactttgagcgctgatgaactgacgttggatggtgaaccattgactggcaaaggggcaacgaaagttatccgtttccttgatatggtccgtgaattagctggcgaaacccgtttcgcccacgttcactcaatcaaccacgtccctactgccgccggcctggcttcttcagcttcagcatttgctgcgttagctggtgctgccagtaaagctgccggtttgacactgtcagatgcagacttgtcacgtcttgcgcgacagggttccggatcagcttcacgttctatctttggtggttttgccatctgggaacgtggtactgatagcgaaacgtcagttgcccacgctttccaagaaaacgtcgattggccaattcagctattaacggttatcgtaagtgatcaacctaagaaggtcgactctcgtggtggtatgcaacatgccctcacaacatcaccgatgtatcaaacgtgggttgactacacgaataatcacgttgacgatatgacaactgcaattaaggcacatgacttaaccgcaattggtgaacttgctgaaacagatgcactgatgatgcatgcaaccaatgccacatcagtccctcctttcaactacttaacagatacgtcttggacaatcatcactatcgcgcagaagctacgtgaacaaggtgtccctgtgtacgcaaccatggatgctggtccaaacgttaagttgatttcacaaccatcagataccgacacgattcttgcggcacttacagccgagttgccaggtgtgcaaattaaggttgcaacacctggccctggaatcaaaatcgttgaaggagatgaaatttaatgacaactgctaaagctcctggcaagctttatcttgccggtgaatacgcggtcacgcttagtggtcaacctagtgttgttatcgcagttgatcgatttgtcactgctgatgtcacgcgtcgcacagatgaccaattagtggttgtcagcgatcaattaggcgagcaaaattggccagtcagcgaacttccaactttgcccctcactgatgattggcgccttgtgattcgcactttgcaggtattaaatgattatcttcttgacaacggtcaacctgtcacagggttgaccgtttccattaagagtcatttaaatgctgacaatggccaaaaacttggccttggttcatcagctgctgtcgtggtcgccctaattaaggcggtcgttgatgactacgagttgccaatgacccctgaacaacgttttaagttagctgcgttaattacgttaacaactccaaacttcaaagctggttcaatgggtgacatcgctgctgcaagtctcggcggcgttgttttgtacagcaaatttgatactgaggttataactgaatggattgacagtaatcgttatttctcagaaatcattgcgcgtgattggccactacttcgtcttgaacgacttggtttccccgctgactggcaactgttagttggttggacaggcgcaccagcagatacgcaacaactgttggcacaaggcgccacaacagttgataagcaacatgctaaacaattattggcccaaaacacggcgccacttgttaacatgttagttgagggcctgcgtcggatggactacgataaggtcgccacggcgcttcgtttgaatcaagaacaactattcacttataccagccaagttgggttatcatacatgacacctcaactgttaacactcctttcaactgcgagtgaccttggtgcaagtgctaaaatatcaggtgctggtggcggtgataacgggattgccattacgaacaatccgttggttgctaaagcgctcacgcaagcctggcttgcagctggcatccaaccgctaccactctcaattgcaactttataggagaaaatgattatggaatctgcccacgcacaccgcaaagatgaacacctagctctagcggaagccgaattccgtcgtaatgccccaacgtcatcattgcacgacgttcgcattattcaccgagggttgccagaaacacgcgtcgccgacgttgatttaagtgtgatggacccttactttaactttacaactcccttctacatcgaagcgatgactggtggtagccaaaagactggtaaagtgaacgctcaactggcaaccgctgccaaggaaactggtttggccatggctgttggatcacaaagtgtcgctttgaaggatcctgaagcaatcgccacatttaagtcagttcgtgaaattaaccccgatggcttcgtgatggccaacatcggcgctggtcacacggctgaacacgcccaacaagttgttgatatgattcaagccaacgcccttgaagttcacattaacgttgcacaagaagtggtcatgcctgaaggtgatcgtgaatacatttgggctgaagagctacagcgcattatcgaaactgtgtctgttcctgtcattatcaaggaagtcggtttcggtatgtcacaagaaacgattgcgcaaattcgtgacttaggtgcccaatacgttaacttaggtggtcgttcagggacgaacttcgctgtgattgaagatcgccgcaatcgtgaaatgacggctgctcacggctacctttacgactggggtcaaaccactgctgaaagcttgcttgaggcacaattggttgaaaacgcgcctactgtatttgctactggtggtattcaagacccattggacgtcatgaaggcccaaatccttggtgccaaagcagttggtgttgctggtcacttcttgcacactgtgctaaatgaaggcactgatggtttgattaccgaaatcactcgttggcaaaaccacttggcaaagctttacgccatggttggttcaacgaaccaggctgacttagcgaaggttaagacggttttgtcacctgaattgaaaaactatattgatcaacgccgttaatgcagccgatttgattaacgaatcattaagacaaggttacgtttgtagccttgtttttttagttttcatggcattttcaaaggattagtaaagcgagtaaaggtcaccttgcgattgccggttatcactgacagctagtcgttttactcggtatattagacgcatgaagaacatgttaacggagagtattcgtcagcagactgacgatcaaattattgatgcaacgctgactttgttgcaaagccagtcctatgaccaacttgcggttactgaaattacccgcatggcaggcgtgtcacggatggctttctatcgccattttggtacaaaggaagcagtcatcaagacgattgtagaacaacttacagatgactttgcgaaggaagccgctgccctaccgttggaaagcgaaatcattgcacgcgaattcttcggattcgtgcaagctaatggtatggcaattgcagttttgctaaatgccggccttcgcgaacaattctacccacctttgcgtgatatcatgcacggcttgtacgcggaattgttccgtagccaagctagtcactcaatgtcaattgactatgtgtctgactttactgcttctggtatgttggctttggccatccgctggattgctacggggatgcacgaatcagttgatgaaatggccaagattgccactgaaatgactgacgcacaacacgcgaacctatgaaataaaggacttggtactataccaagtcctttattttttgtctttagattcctgaaacaccgaagtatagaccgtctgggttcgcaaagttaaagaccttttggagacccatttcgactaattcgcccttttcaacattcaattccgtcatcttgttgtacaacgcttccacgtcgtctgagtggaacataatcgaaggtacgttatcaacaacttccggtgagttctccttgatgaactcacggtcaaagatattcaaggcaaatgcgccatcttctgaaggtgccacttgcaccatttcagtctcgcccatatcttgacgatcacgctcaacaaaccccaaagacacccaaaaatcagcttcacggttcacatcacttacgtacaacattacttcaacgtcattattcatgttcattctcactttcagattgtacgttaatgttaacattttgcatggcagtcacgcaatttagtaacgctgcgattcctgaacaccttgtttaaatcctgcaatagtatcttgcgttgctgaaacgatgtacggtgtcgcaactagcagtagccataccattaacaaccaaaacaacttacgattacaaagcagtttgtttacgtctcgccaaggaatattcatcatcaatgccacaaacgcaacaagttgtgcaaactcaaataatccttgtgcccaaacgtcttgaaaaagactcggccacatactaactgatacaaaagcaagtatgctaatgccaataattgaaaagacaactttttctgtcggtgaaagtttgaatcccttatccttttgatactcctcaatcaaccgatcatccccacgcaccaactcatccaacgaaagattaaacacatccccaatcatcaacacgcttttgaaacttggtagcgctgtgtcattctcccactttgaaattgattgtcgggttactcctaatttgtccgccaactcttgttgtgacatgctgtgctgctcacgatgcaattgaatgttttcaccaatcctcatgttatatcctccgctttcctaccccttaactttacaagaatgccggtatatcgccaagcaactgacggttgcacttgaaaaacatatcgaaattaacgacattcgacaacagggcataagaaaaaagcgtaccgattggcacgcctttcctttagttaaccgatattgtcacactcaccgaataatcctggtcacttggcaatcgatacgctggttgcacatcactgccccaactatcgataccaccaacaccgcgaactgcgccgtaaaccgtcaaaaccgttcgacgagccggtggcaattcattttgatgggttgctgattctaattcaaccgccgtgtatggtaatgctgaaaaggcaaattgattatctgtcttatccacacgtaaatgagaaccagtatggtgggttaatgtcacccagtccgtcttaatatgcatccccatctcttgtggcaccaaatatggcgtaaccggtagaccttcaacttgatgaatacccggttcaccaccttgccaacgatcaggatacgtttcacccgacaacccctgatacgtgaagccagtaactggcgcaggcattacgagtcgcaacccgaaagctggcaactctggcaagtccgactgacctaaataagttgcggtaatcgttaactcaccaccattaaccacctcataactcaccaacacagttgtttgtggtgaagttggtgtctgataggtgaacgtgatttttactttgtcggctgtttgctgattatcgtatcgattgttttcaggcgccacgggcttggcaatctcaaccccgtcgactataacgttgaaatcaacggccgcactgaactggtcggcgccaaaccattgcgcgctcttagttgaaaagccattcccacggtcgttgtccgtagttgcacgccagaaagctggctttggtacacggtacaaccactcaacgtcgttcacacgcaacgatttcaagccgcctttttcataactgaataggtaatgcgtatcggctgtatgaacaccgaggacgccatcaccatacacaaccttcaatttatttgttttcatatcgctcatagaaatatttcacctcttgcattgctggcttcaactgacggtcggcaaagacaataccgttacctgagaattcataatcagaatggcgttcgttaaagtcaccaccataggctaaaaatcgttgccccgtaattggatcgtcttgccacaaggcctgatctttgaaatcccaaatgaacccgccaccatatgcagggaactcatcgtacaaggccatgtattcgtcaaatccccccactgaattacccatgctgtgcatgaactcacagtttagataaggcttcttaggttgttcagtcagataggtccgaatatcagccggcgaggcatacatccgactttccacatctgaaatctggtcgtcatactcccggttatggaagaccccttcatagtgcgttagtcgcgttggatcaacctgcttaaagtacgcattcatatcagcgatgttatcaccagcatacgattcattaccaagcgaccaaaatagaatcgacacgtgattcttaaattgctcatagttactctgtgcccggtccatcacgacatcatgccaagccacatgtgaaccagggacgttaacggatggttcaacttgtcccatcttctgccaggtaccgtgtgattccaaattcgtttccgccattaaataaatgccagcttcatcggccatgaaataccaaggcacctggttcggataatgggatgttcgcactgcattgatatgattttcttgaataacacgcatatcctggcgcatatcggcttcgttaagcgcacgccccgtttcaggcgaccattcgtgacgatttaccccattcagatacaagcggtgtccattcgactgcaactgattatcagcgccgattgcaatcgttcggaagccaaatggataatccacaaaagcaacctcgtcaccgcttccattggtcaccgtcacttgcaaatgataaagatttggctgttggtgagaccacagtgcaatgtctggcacaagcaagtctgccagactcacttgctcggcagcactaatcttcgtttctaatagcgattgctgattatggtctaaaatcgcaatctgaacgttacccgtcactggtgttgttgctgataactgcaacgtgacatcaaccatgccgttgcgaccatgcacagttggcttaatagcgacgtccgtcacgtcaatttcaggtaatgcgcgcaaccgcacacttctgaagatacccgagaagcggaacatatcttgatcttcaataaacgctgccgtacttagcttatagacagctactgcaatcatattttgtcctgcatgtaactgctcagttatgtcaaactcagctcggctaaaactatcttcagaatagcccacgaagttaccgttcacccacagatacatcgcctgttccacaccgtcaaatgtgatatgcatccgcttattttcaaagtgcgttggtaattcaaagaccttaacatattcgccaaccggattatccggcgcgtcgctgaaaatgcccggcaccccttgtgtatccccatccataaatggtggacgacggtattgttgcccatcccatggatacagtgtgttaatgtattggatttgaccatatccttgtaattggatgtggccaggaaccgaaattctattaaattccgcccgcgccgttgccacctgtggatcataaaactgttccgttcgttcgcgcggtgatgccccgtaatgaaaatcccactcaccatcaagtgacaacgtatcagcttggtttcccgccttgtaatctgccttatctcgatagatttcgtgatcactgtgtgctggcagtttgccaacacggaatacacgcggatcatctaaccattcaagtttcgcttccatgttcccctcctcttttgtatgcgcttacaaatcatttttgaaaaatggcacctccaacactgttggaagtgccatttaactgttatttacctgctgctgttagatgtgcgataaagcgcttcagtccctcatgaccactggcgtcatacttatagacccctgcatgagtcagcacttcagcaaacacctgtccaacggcttgttgcacaatttgatggacattgtcaggcgtcaccgtatgttcacgggccaacatttcagcccatggccggtgtccttcagcgacctgattgatgtccacctcaccaagcaagaatgcttcaacatcaccgagttcatctttcaaacgcgctggcaagatagccaaccccatcacttcaatcaagccgatattttcgcgcttgatatgttgtacgtctgggtggggatggaaaattccttctgggtattcagctgacgtcccattatcacgcaaaaccaaatacatgacgtataatcccggacgcttcattgcaatcggtgtcaccgtatgttgttgttcaccacgttcactcgtcgcatgaatatccaaacggtcatccgagtatccttgccaagcttcacgaataaattcgctagctgctactagcttctctttatcggttgccgttaaacgaatggttgtcattggccaacggacaatatcagctcgaatatccggaaaggccggcatcggaatttcgcattctgtcggcgctttcatcaacggaaagacatggcgtccaccttgaaaatgttcttgtgacagaattgatccaccaacgattggcaaatccgcattcgagcccacaaagtacattggatagcgttccacaatcgtcagcaagttttcaaacgtcgcttgattaatcaccatcgtctcacgttcaaaatcaacaaatatcgcatgctccccaaagtatgcatatggcgaataatgccagccccatgtttgcccttgcaatgattcacgaataaagcgatgtgttgcgcgcggtgcttgtgtaatcgagccggcgtacccttcattcgtataatccaaggcagttggcggatacgccgcttttggtgcagccgcagccgccttgatttctgccgtcgtcttctccggcttcgacaaattaatcgtaatttccaaatcaccaaaatcagatgtcgcttcgtaggcaatattcttttgaatatcagctactttaacgttttcaacggcccggcttaagtcatagtaataagcaactgctttttcagggctctgggcatacaacttttcaaaattgctttgtagtcgatcaggtgttggcgtcacaatgttcaacaagcgtgctcgcatcacatctagttgccaacgctcatcgggtgacttatcagaaatatccagcaacaatgtcgtcaattcacttagcgagcgctcagtattccctgtctgtccatcaacaatcccatcaagaccgatttcagccaagactaagttagtccgataaactgtttccatttctgaataggcctgtagcttaacaccccatgccacgaaatctaagaccaattgactactatgtgaatctaacataacgacttcctctacttaatttcatgcgtaccagcaacaatttcggcgacgaaaaatgatggctggtagccaattttgttggtgtatgcttcaccaactgctgccgtgatttcaggtacacgggcttcttcaactaacgcgatggctgaaccaccaaatccagcaccagtcatacgagcacctagcacgccagtttgtgccaacgctgcgtcgaccagtgtatctagctcaacaccagttacttcataatcatcacgcaacgaattgtgcgacgctgttaacaattgcccaaacgtttccaaatcgtggtcctgcaaagctgcctttgcttctaccgtacgttggttctcagtcaccgcatggcgcgcgcgacgcataatgacctcattatcagccgttaatgacgctgacgctgccaggaattggtccgtcgttaaatcacccaacgtttggatatcaacactttcttggagcaaagccaatgctgcttccgtctccgcacgacgttcgttgtactttgaatcaaccaattcacgtttcttattagtcgtcatgaccagcaaacgatactcaccaaactcggccggtaccatctcatattcaagcgtgttagtgtccaaaaagatggcctgttcgtcttcaccaaaggcgacagcgaattgatccataatacctgtttttagtccaagataatcattttcaactgcttgacccatcttcacaatggtcaacttatcaatctcatatcccatcaagtcagctagcatattaatgagcaacatttccaatgaagctgatgatgacagccctgatgctgttggcatgtcaccaacaattgccaagtcaaacccttttgttacggggtagccaaacttggccatttcagtaatcacgccacgtaagtacttaatccatgtatcatattgacgcaatgcgatatcatccaatgcaatcaattgaatcccagcctctgggaagttcgctgaataggtgcgaatctcttgatcatcacgtggtgcaatcgcgccatacgtcccaacactaattgcagctgggaaaacatgacccccattataatcggtgtgctcaccaatcaaattcacgcgacctggtgaaaagtacaacttcgccggctcatagccaaaacgcttctcgaatgattgtgctaactcatgatttaattcataaaccattttaattctccttcaaacgtgcttccaattccgccacaatctcagcgtgacgtgcttcagtcaacgtcaccttacgccagtaaatcaaaactgacacgatgatcaagaccattggaccatagaacataaacatcttaaacatacttaggccatgtgcagtgatatctgatggcttagagctaccagtcatcccggctacaaccgcagcgaatccgacaacaccgttagcgaacgcacctgccaacttatccaacaatggtcgaattgccaatgtcactgattcgtgacgagtgccaagcttccattgaccatattccactgagtcggtaatggtcatcaacacaaccaagaacatgattgggtatggcataaagaacatcgtgacagccgtcaaaaccaacgccaaattgttacctgcgaccataaacaacaagtaacctgctaacatcacaaccgcaccactaaagaaaatagtgcgacgagccaaaaacttcgttaacgttgggaagatggcaactgaaatcattccttcaattgctgtaaaaataccaaccaagtaaaactcattgtctgcacccataacgtacttgaaatagtacaacaatagtgagtttgtgacaacatacgcaagcgcgaacataatgtaagaaacggcttgccacatcaattgatcgttctttgcaacaaccttaaagacttcgagtacaccaactttttccgtattttgacggacgacattgtcctcttctttagtgccagctgcagttaacaaagcaccaaggtaagcaataaccgcaatcataacggcgaaccagaaccaaccggtcttcgtttcagtatgtgccccggcaaaggccattgagaagaacattaccaatggcacaacaacgatttgtacaccttgttgacctagcgttgacccaaagcgggctaccgttccaaacttctcacgtgtactactattcaatgacaaagctggcaacattgaccagaaagcaatgtccttaaatgagtaaaacgcatccaacgtaacaaacacaatcccaaacaataccaagtaaaggaatgggtgtgatgttgctaagcccccaaagtcagtaaaaataaccaccaacaagaacgaactaataaatcctgcgataattagccatggcttaaactttccccatcgtgtccgtgtgttatcaacaattcccccaataattggatcaaacacaatttcaatcaaacgaatggcaacaatcattgttgtcacccaaccaatcatttgattgttaaatgctttatctggcgtatcaaataattgacccgtcacaaaaatcataaaatacgtactaagcgttgcatagaacgcatcgtgtccaaacgcacctgccgcataagacagatactgcttcacatttttcatgcttatatcccccgatatttggtttcataattaacctactcacttataataaagcgctttcattagctaaaaaggcacttttataaccaaatatcatgatttattgaaaccctgtgaattgtcgcacaaaaaaaccagcagaaaactgctggttcaccatttcatgtttgccattggcgataatttaacggactaacaccggtttgctttttaaaaactttgccgaaatacgtggggtcttgatatccacttagattagcgaccgcttcgacacgtaaatgacgctgggaaattagcaattttttcgcattactaattctgatttgcgtcaaatactcattcggtgtttgttggacgagacgtttgaatacacgattcaaatactgcgttgaaaccgataaggcttccgccacctctgcaatcgacatattttcagcaaaatgattctgcatatatgcgatagccggtccaacataatgttgatagtctggttggtgctgatcgatggtttgtttttgttgacgcgttaagcccaacaaaagtcgataagccgtcgttgatacagccaaatcatctaccggatcagttgctaattgttgcattaactgctcgtgtaaggtggcatataatttggcttctgttgcttcaactaaaacaaactcgctattcaccatttgcttcagtaagtcatccactagttgcccctggaatgtcgcaaaacgtacttgccacggccgtttacccaaaggttcataccgatgtggcacacctggtgcaatcaaaatccccatccccggcgataattcatagcgtttatctcgtacccaaaaagcccccatccctgattgcgtttgtaaccaatgaaaatgcgggaagccttggtgacgaatgataaccccctgattccactcagccccaagatgttcggccattactggcaaactcaaatctgcaatgttataaaaagtacgcataataacccccatacttactataacaaatcaaactcaagttgacttagccatttttgcaatttgccccataacgtaaaaaagaagcagccacataattgtagctgcttcgatattatcttaaattagaagttgtacttcgtgtcttcgtcgttaaccttaacaacttgtgacttaagtccttcttcttcaaggaacttacggaatggcacaagttcttgtgcgtcataacgctccttgaaagccttgatttcttcttcagatgctagggctggatcaagcttcaatccttcaacaggaattggacgctccttcgtaatcttagcatcaaccacaacaacacggccttgcttgtagtagtcaacggcttcttgcatcaccttatcgatgtctgcaatgctgttaaccgtcaaaccaacggcaccttgtgcttcagcaatcttggcgtagtcaacgtcaccaaagtcaacgatttcatcgttacggtaagtgttcgtatcctcatacttatccttgatgaagccgtattgcgtgttcgtcataacaacgttaataacaggcatgttgtaacgaaccgccgtcacgatatctgaatcagtcatcgcaaaggcaccgtcaccggcgatgttaaatacttgacgatctgggaagacgttcttggcaccaattccaccagggatggcaatacccatcgttgcgaacaatggtgacgtacgccacatgttctttggtgtcatgtgcaagtgacgaattgacatttgcgtcgtgtcaccaacatcaattgagaagattgcatcttcatcagcgtacttgttgatggcgttgtagacttggtaagcctccaaaggaccttccgtcttcgtctcaatcttgtgcatgtagtcacgccagttttgggcatccttcaaagcagcgttccaccatgctgactcagcaactggctcaaccttctccaaaagcgcttcaactgccaaaccagcatcagccaacatcgcaacgtcagccttgtgacgacgtcctagacgagctgggttactgtcgatttggatgaagttcttaacaccagccatgaagttctcaacttgtgagaatgggtagttgttaccgataaacaaaacagtatctgcttcgaagataacatcgttacctgacttccaagcgacacgtccagcagaacccatcaaaccttcaaagtcgtaatcaaaggcttcgtagctcttggcagtcgtcaaaacaggtgccttcaacttacgagacaattcttggactagctcaccgtgaccgattgttccgaaaccagcgtagattactggacgcttagcattcttcaaaatttcaacagcggcatcaacatcagcagccttaggtgcaactgggtcgtattccttgtaaacatcaccagaagagtaaattgggttagcgtagttcatttcagcgtcaatttcagcaaatccgaaatcggctggcacttcaagaacagcgacacccttctttgaaatggcattgcggatggcatcgtcaatcatgtatggcaattgctcaggaacagcaacgcgcttgttgtaaacagcgatgttgttgtacattgggttttggttcaactcttggaatgaatccattcccaattcacgtgatggctttgaacccaaaattgccaaaactggcgttgcatccatagcagcatcgtacaaaccgttgatcaagtgagtagcaccaggtccaccagatccgacagcaacggccatcttaccactgaacttgtattgcatggcagccgccatacttccaacttcttcgtgcttaacttgaatgaacttgatgttgttctcaggattactcatcgcgttcatcaatccactcaaagttccagaaggaataccgtacattgtgtcgataccccaaccttccataaccttcaatgcagccaaaccggctgtaatcttcttatctgacatgagataagcctcctgtttagacaaacaattattctccgccaccctagccaaacaactaggccgatgaagatgattaattaaataattacttacgtttagtatgacgctttcaaacacttaagacaaataaaaaggtttattttcctggaaataattgtaagcgcattccaacacaattatattaacgcttttccaaatcgatggggcaaaaaaagagcacctactcgaaagtagatgctctctttaagacttaaggtaaaatgcagattaccaagaagccttcttaacaccagggatcaagcccttgtgtgccaattgacggaagttcaaacgtgacattccgaactcgcgcatgtaagcgtgaggacgtccatcaatcttatcacggttgtgcatacgtacaggtgaagcgttgcgaggcaactttgacaaccctacgtagtcaccagcagccttcaaggcagcgcgctttgcagcgtacttctctacagttgcttcaatcttcttagccttagcgatctttgacttcttagccatgattacttaacctccttgaacacagtgacacgacgcaactttggagagtacttcttcaactccaaacggtctggcgtgttacgacggttcttagaagtcaagtagatacgctcaccagtttcggcggcttccaacaaaatgttaatgcgcattaacataactccttgaatttaatttgtgaggtgcccctcaccactaatttgaacgacaggattagctgcattgggctaatccccaagcttgcgccgttacaatatagctagtaaattacaaataattatattacacagtttattgagaaaattcaagtgttttccctaaaaaagtgacaagtaattttactttacgcgttttaagcttgatttatcaaggaaaatacgcattttttcaatgcaattacttcaaattccaagccgcactttcaaacccgttgtacaacttattaatttccttttcagttgtcttggtctgataaaccttaacaatttcgcgataggctttcgtcttggccttatccttacgcgccgcaatgatgttgatgtatggcgatgccgtctttggattagacacatcttgcgtcaacaaaacatttttggtttttagtccggcatcttgtgcgtagttaccgttaatcaccgctgcgtctgctgacttcaatgctgacacagtttggtcggacgcaatttcaacaatgtccaacttcttatgattatctgtaatgtcctttacagttggtgtatcaacactctcattatacttaatcaacttggcttgtactaacaaattaagcgcgcgttgttcgttcgtcgcgtcatttggaattaccacttgtgccccatccttcaaatcagcaagcttgtcatgcttcaatgaatacaaacgaatcggtgaaatcaccgttttaccaatcgaaaccagcttattacccagcttcttattttggtcatcaaagaacacctttgtttgaaaggcattcaaatccaaactaccgtccacaagggcttggttcggctttacatagtcactaaaaaccttgattttgattttcacgccatacttcttctcggtacgcttagacacattttcccaaagctcacgtgatgaatcaccaacaataccaactgtaacggttttatcatcagtatcagccttcacgtgattaattattgtcgtacctaccgcaatcgtcgttgccactgttacagcagccccaagccaaatcttcttattaaccatctgttttccccttaatctttttccgaataatccgcaataagtgcggctaccaatgccacatgatgctcgtaatcacttaaccgaatgttttcatttggcgcatggatttgactgccatcataagctaacccaactgctgcaatcggtgcgccaatgtatttgttcgcccagtacattgggccggtaccagccgatgttggtgacacttcgacggtgtggtacagctgttcagccaatgtgaccaacgacagaattcgtggtgctgacatgtctgaacggtatcctggcgtcgctaatgttaacgtcgcttcaacatcgccgaatccatttcgttttagctgacccactagtttgtcaaacacatcttgtggttcttggcctggtactaatctaatttccaacttagccctcgcgcttgctggtgtgactgttttaacgcccggaccctgatacccactttggattccctcaatattcaggttggacttaaagaacaaattgtcatagaaatcctcacccgtcgtctcagtcaataacggccgtctcaacccaaagtcacgtttcaagcttgctggtgtgacttcaccaccccgtactaaagcttgctcgcgttcattcggctcgcgagctgtctcataaagcccatcaattaaaatttcaccatcttgtcctcttagtgacgcgatggcatcaatcaaacgccaagccgctgaatcaacgactgctgcaaacgatgaatgaatatcttctgccgccgtctgtgctgaaagcgtgaacgtaataatccccttattacccccgaacacctccaaacgatcatcaccatggacggtaccagattcccaaataactaaatcgacattttcaaattcataagcatacttttctaggtaatccttaaaatgttcagatccggactcttcagcaccttcaactacaaagtacacatttactggcaatgtttcatgcagtgcaaggtaatcttcaactgcttccaatcgtgccgtgatatgccccttatcgtccgctacaccacgtccatatagtcgcccatccttttcggttaacgtaaacggatcagtttcccatagcgcaattggatcttccggttgtacatcgtagtggttatagagcaccaacgtcttcgcatctggtcgattgcttaaaaacttagcgaggacaaacggcgctggaaaactgtcatcatacgtaacttctgcaccggcgtcacgaaagacatctcttaaatattttgctgcaacatctaatccctctcgacgagccgaaacgctcggtatcgcaactaaatccgataatacctgtaaatttttctctcgattactactcatccctgtttccctcatttattcattaactcacatcgaatcccgcgttaattcgatgctgtcggttggattttccacaaaaaagtcccaggacatccaaatggacatcctgggacgacataatcgtgttaccacccagttttccctttttatcaccaaaaagggcttcatacgtacgccttctgaccggactagtcaacggtcgccggatatacgtttgcgcgataacgggcgcacccggttaatgcttgcaaatctgctcacatcaactctgactcaaagaccattttcaccccttgccaaatgccaactcacaccaaccgttggctctctgtgattttttcaggacttacttcatctcgtcgttgtcgataaagtaagtatatttgctacattaaagaatgtcaacatattttctaatgcaattttaatttaacgtggcagttcattataattcgcgatgaatattctggaaattttgctcaatttgattcagccattcgcataaccaatcaagttatcagcaaactcttcaacacgttctgcgtcagttttgtagcgcaacttgtgttccaagctggcccacatgtccataccgattgttctgatttgaatctcaaccggtacacgttcaacacccgtcgacctgaagacgggaatttcaaccactaagtgcaagctgcgatagccacttggcttaggattttcgacataatccttgcgctttaacaaagtgacatcatcttgggcgactaacaaacgttcaaccgtgtaaatgtcatcaatataattcgtgatgacgcgaatgcccgcgatatcaaagatgttatctggaataatatccacagtcattggcaagtttttccgttgcaacttgccaaacaaactttgcggatccttcatgcgtccctccaaatgatggattgggttatggttatagttcatttgaaactcagcatcaagattttctaatttcgtcgcaatctcatgttgcgcagactcgtacgtttgatacatgcgggcgaatttcgtgagttcttcgacttctaccccgatatttaggcccgacgtacttagcatgtcgcgcatttggttgacgtttatcgttgaagctcgttgattaatcattgctacactccgtttcaaaatctttgtatatattatattgaaacaggccaaccttataccagactatagatttataagttcgaaataattagcgtcgcttttccaaaccactattttgcccatctagaatgcgcgtcgcttccttcgccaagtcagccaacgtaattggtctaagtcgcttagcgggaagcttggacaagatacgaccaacgtaataactcatctggcgtttcctatcataaataatacctggatacagcgtcgttgctcgctgtggcaaacgcaaagccatgtaattctccacttcttgcttcgcacgcatgtatggtgccatgaagaaaggtgcgtaattggccgacacgaacatgaacttaacctctgggcaggcgcgtacagcgtcaattaaaaattgcgccggtaaaacgctgctattggcatacgtttgatgcttaatcggattcggcagcagaatgccaatcacatcaatcacccaatccgcatccccaatcaccgctaacacctgatcagttacgtgataatcaacttggtggtacgttactgactcggtatcggttgttacgtgtcggcgcgtcagcacatgaatgtcatatttttctggtgataatgcactggtaataccttgaccaacaaagccagtgccccctgcaatcacaattttcttttttgccaaatgaacatccccgtctttcaatgtgtcctagtacttcaagtttacacattgtaagccacgaacccaaatcaaactttcaacacagggtacaaaaaagcaccccgcaaaagcgagatgcttaattaaaattctttattaatcagttgccttagtttcgtcacgaatttctggcgtatcatcgataacaccagcgtcaccacgcaacacaaccccaccgaacttcttaacgtccaaaaccatgtttggcaccatgtagtcctttgagtaacccttgattggcaatggaccgatgtttgaatcgattgtctcgtcaaaccatggctccaaaggttgttcaccgcgaataacagcgaacacgaatgaaacttgcatggcaacttcaccgtggtgtgagtaaggtgaaaccccgtcttcatacatcataatcaaacgacgacctggctcagccttcaaaattgggttaatcttttccattgcagcgtcagtaattgtcaaatacatctttccatcctccttcagagttagtctgaatttattcatttcatatctctttcaacacttacagtgtagcactgtgttaaacggatggtagaaaaaagggttattcagctaaacgcatgaagtaccaactgatgtatcccatggcaaccgccaagacgtcaattgccaacacatcaaagaatcctgataattgccagccaattaacgtcactgcaaattccaaaaaattaaataggacgtacagaattgcaaagagctttaagccattggccaacgtcgtcatgtcgtgtgtttgtgccgcactccccacgcgccagattgtccaaccaagcaagatgattaacaatccaaacacgatattacgagctgatacagccggtcgcagaactgcctccacgatactgttcaatggccaaataaagtttagcaagacgccagccaaccaaaccagaatcaactgttgaaccgtttttaccaagtccgtgtagtccttatagcgtgaataacgccatagcgctgctaaacccaccgcaatcaacaagccagcaatcagttgcaatcccttaaatgctgtcgcatattgtgaatcaggcgccgtgagaatagccaatggataggcgaccatccgatacgctggccaaataatcgtcgcgatcacactttgcaagacgtatagcaacatgcctaccatgccaacgcctaaaattaatttactttgccaccattgtcgcatgtcttcacctcatcatttttcagtaattctattttacgcaaaaacgcagtcaacaactagtagttgactgcgttttatgttatttcattaacttttcaatctgtgtttgcacatgataccaatcacggtaacgcacgatatcgttaaacaagaccgctcgcatcagtagcctgatagcgagtaatacaatcgcaaccactagcgcaactaatgagatgccactgtagggccacaattccccgtagaatagtccggctgttagaaaaaacagcacgatattcgctacaatcagcaatttttcatggatgttgtacgttgttttaagctcgttttcaacatcatcaggctgcaaaccactgttccaccagttccgaaataggcgttcgcgtctcttaaaaaacatgtccttccctctgttccccaaagtatgttacatcgcttactttaggtacattctagccaaagaatatgatttttatgtgaactctccttagcctggttcaacttcgatcaacaagtcaccacccgccactgcttcaccagcagcaacgtggacaaacttaaccgttccatcgaatggcgcttgcacagtcgtctccatcttcatggcttccgtcacaatcatgacgtcaccttgcttcaccgcttgaccattttcaacgtgaactgacaacacattaccagccattgttgcgccaatctcatttggattcgttggctctgccttacgacgggcaactgttgtcacttggacggattcgtctagcacatcaatctcaattggcgtaccgttcacatcaaagtacaacgtccgcattccctctggatcaacttcaccaatttcttgaagttggaagataacgacctttccaggtcccatttcgatatccacacgctcaccaacacgcatcccctggaagaacgttggtgtatccaagaatgtcattggaccaaacttttcttggttggccacatagtccttaaacacttgtgggtacaagatgtacgaaataatctcttctgatgttgccttacgcttcaaaatcgcttcgatttcagccgtcatcgcctcaaagtcggccgctggcgtcaatgaaccaggacgtaccgtcaatggcttgcgacccttcaacacgacttgttgcaaatcttctgggaaaccaccaaccggttggccaagatcacctgcaaagaaatcaacaactgattgtgggaagtccagcgtttgaccttccgccaacaccttttctggcgtcaaatcattttgaaccatgaacagcgccatgtccccaacaacctttgatgacggcgtcaccttgatgatgtcaccaaacatttgattaacagtagcgtacatcgtcttcacgtcatcccaacggtcacccaaacgcaatgcttgcgcttgttgttgcaagttagagtattgaccacccggcatttcgacttcgaagatgtccgtttgggcaccaaccatcttgctcataaactgaccgtagtatggtcgaacttgggcccagtagctgttaatgtgctcaacagccggcatgttcaattctggttgacgggcattaccactcaacgcgtaataggttgcacccattgatggctgggatgtcgttcctgacaaggctgacatcgcgacgtcgataacatccacccccgcatcaaccgcacgtgcatatgtgtaaacgccattaccagttgtatcgtgcgtgtgaagatgaattggcacatcaaccgcatccttcagcgcgctaaccaactcataagcagcttcaggcttcaacaagcccgccatgtccttaatcgcaatcatgtgtgcaccggcactctgcaactccttagcgaagtttacgtaataatcacgcgtgtacttcttacgcgttgggtccaaaatatcacccgtgtaagccatcgcaacttcggcaatcttgttgttgtcgcgcacatattggattgacttttccatttgtggcaaccaattcaaactatcgaagatacggaacacatccatcccgttcgtcgctgctaagcgaataaactcttcaagcacgttatctgggtaattttgataaccaacggcgtttgaaccacggaacagcatctgcatcaatgtacgtggcatcttctcacgcaatgcacggagacgctcccatggatcttcacccaagaaacggtaggccgtatcaaatgtggcaccaccccacatctcgtttgagaagaggttcggcatcgccaattgcgtttcatccgcaattgccaacatatccttcgtacgcatgcgtgtggcgaacaatgattggtgcgcgtcacgcatcgtcgtgtccgtcaacaaaaccttatcttggttcttcacccattgtgccaccgcatctggtccttgggcgtccaagatatccttggccgttaccaaatcagaaggcaacaccaaatcagcatttgcttgataatgcaatggctcatagagcttctggtaatcgtgatcaatgcctgggaaaccgttaaccgttgtctcactgacatagcgcaacaacttgcgatcgggttccttttctggcgcaatttcaaacaattctgggtgcttgtccacaaacgttgttggcgcatcagctgcacggaacgttgggtgcgcgtaaacattcttcaagaatggaatattcgtcttaaccccacgaatggcaaactcattcaaggcgcgttgcatcttatcaaccgcttcagtgaagtcagttccgtgcgccacaaccttaaccaacaacgagtcaaagaacggcgtcacagtggcaccggcgtacacgttaccggcatctagacgaatgccagttccacctggtgaacggtaccaatcaatcttaccagtatcaggcatgaagttattggctgggtcttccgtcgtaatacgtgattgaatcgccacaccgaccgccaacaacttatcttgggctggaatgtttaatggcgcttcatgcaagccgtaaccttgggcaatcaacagttgtgacttcacaatgtccacgccagtaatctcttcagttaccgtgtgttctacttgcacacgtggattaacttcgatgaagtagaaatcgtccccatcaaccaaaaactcaacggttccagcactttgataatcgacactttgcatcaacttgaccgcggcatcttggatacgacgacgcatatcaacggatacagaaaccgccggtgcaaactcgataatcttttggtgacgtcgttgaattgatgagtcacgctcaaacaagtgcatcacttcgccttgttcatccgccaaaatttgaatttcaacgtgcttagggtcttgtagatacttttcaagataaatttcagccttaccaaagctttgttgtgcttcagaagcggcacgttcaaaggcttcacgtagttcatcatcgtgctcaacaacacgcataccacggccaccaccaccggcagccgacttaacaaacaacggatagccgtgttcagcaccgaaagccaacgcctcttcaattgattcgaccgggtgatcagttcccggcactgttggcacaccggccttaattgcggcttgcttagccgtaatcttgtcaccaaacatcttcaagtgttcaacgcgtggcccaacaaacttaatgccggctgcttcgaccgcagatgcgaactcgtcgttttctgacaagaacccataacctgggtgaatggcatcggcgccagtttccttagcaatacgaataatatcgtcaatatccaaataagcggcaattggcgccttaccttcaccaactagataagattcgtccgccttgaaacggtgaacggcaaactcatcttccttggcaaaaatagctaccgtcttaatccctaattctttaccagctcgaattaaacgaacggcaatttccccacggttagcaatcaacaatttcttcatgaagtgtccccttatatcgttttggccgttctctgacgaccgcttaaaacgtcccatacgcgcagattcattcatttttcatctacatcagaactttctacccattataccaaataaaatacgccataacgagtacgttatggcgtaaatacttatttaatcttcgtagttttaatttcttcgaattgtccttcaaaggcattacggcgtgaaccgttcatgctttgatcagaaaatggcatttgttgctcaacgtgggccaccgcacgcttaatgcggtgcttgccgtagaaccagaggccaatgactgcgatgataatcaacgtaaacatcttagactcccccttttcggtttcaatgacaatagtctaacaggcgaaccttaacgattacttacctgcttgcgcctttaaacgttcaacatcgcgggcgatttcaagctcttcattcgttggtaccaacaataccttagctgttgaatcatcggttgaaatgacacgttcaacaccacggacattgttcgcttccttgtccaacttaatacccaagaagtccaaacgatcgatgatgtcttcacgcacgtttgcagcgttctcaccgataccagctgtgaagacgatggcatcaacgccacccatttcgaatgtgtattgacccaagtaacggatgacacggttcaagaacatatccaatgccaacttagcgtgctcgttggtgtcagccacttcttccaagtcacgcatgtcagatgacaacgttgagaccccaagcaaaccagacttgttgttcaaaatcttcaacatttcgccgtttgacaagccttcgcgttcttgaatgtagtaaatcaatgatggatcaacatcgccagcacgcgttgccatcatcaaaccagccaacggcgtgaagcccattgacgtatcgaatgacttaccatccttgatggccgtgattgaggcaccggcacccaagtgaagcgtgataatcttcaactcttcaagtggcttacccaaaatatccgccgtacgttcagcaacgtagcggtgtgacgttccgtgagcaccatacttacgtgcaccatacttcgtgtagtactcgtatggcaatgggtacaagtaattctcacgtggcaacgtttgatggaaagccgtgtcgaagactgctactgaaatagcatctggcaacaactcttggaatacttcaattcccgttgcattggctggattgtgcaatggtgcgtagtccgccaaacggtgaatcttgtgcaacacttcttcatccacgataactgacttgttgaaccattcaccaccagccacaacacggtgcccaacacctgtaatttcactcttgtcagccacgttttgtgcacggaattgctcaagcatttcttcaattgcttccttgtggtcagcgatgtcacggacgatttcagtcttttccccgttaaacttcatcgtgaatacactttcaggcaaaccaatacgctcgatttgtcccttggcaatcactgtttcagccggcatttccaatagttggaacttcaatgatgaagatccggcgttaattgctaatgtcttagccataattcatgctccctaatacgctggaaataaatccagttaataggattagtgtaacatgtaagcgttaccattaccatactttttgtaacaaaaaggctaactagattaactagttagccttttgaaattatttaaaattactttgctgcgttcaattcaacaatcttcaagatcgtatcaaccgcttggtgcatcaccttcgttgaaacgtactcgaaacgaccgtgcatgttctcaccaccagcaaacaagtttggcgttggcaatcccaagaacgtaatctttgaaccgtcagtaccaccacgaactggttcgatgactggctcgatgtccaaagccttcatagcggcttcggccaaatcaacagacgtcatgtcgtccttcaagacttcacccatgttgtagtattggtcgtacatatccaacttgatacgctcaacgcccaattcaccgttcatcttttcaacgatgtcacgcaaggcttgcttacgctcttcgaagatgatgcggtcgtggtcacggatgatgtatgacatttcagcttcttcaggtgtaccgttcaacttcaagatgtggaagaatccttgacgaccttccgtcaactctggacgatcaccggctggcaaagcagcgtgcaagtccattgcaacttgcaaggcgttaaccatcgtgtccttggcagaaccagggtgcacattacgtccttgaatcttgatgttagcagctgcagctgagaacgtctcccactccaactcacccaatggaccaccatcgactgtgtaagcaaagtcagcaccgaattccttaacgtggaagttatcggcaccaataccgatttcttcgtcaggtccgaatccaaagacaaccttaccgtgctttacctcagggtgggcaatcaagtattcagcagctgaaataatttcagcaaccccagacttgtcatcggcaccaagcaaagtcgttccgtcagtcgtaatcaacgtgtgtcccttgtacttcttcaatgaagggaaatcagctggtgacaacgtgtagtcgtcgttcaacttgatgtcagactcaccatcgtagttttcaacgaattgtgggttaacaccttcagcgttaaagtcagccgtatcaacgtgtgaaatgaaaccaactgcaggcacatcagcgtcaatgtttgaagccaattcagcaaagacataaccgtcagccatcgtacgcacgttttctaggccaagacccttcaattcttcagccaaatcagccaagaaagcaacttccttaggatctgatggcaccgttgttgactcttcgtttgaacgcgtgttgaccttcacgtaacggataaaacggtcaaccaagtttggatatagttcttctgacataatagtaattccccttaaattaaatatacgtatatggatccgtgttttcagttgaggcgaagacacggtctaggtcccaattgttttcggtttgccaagcattaaccagttcaactagcttatccttggcaatggcctccatgtggtgatccggatcaatcaccacaaaatcatcggccaagacgtcatgcgccgtgtggtagtaaaaatcagctgtcacataagcgtcagcaccagctgccaaggcatctgggtattcactaccgccatccccaccaagcaccgcaatgcgttggatagaacggttcatgtcgttcgcaatcacgcgcacgtgcgccacattgaacaaatcacgcacgaatgttgcgtaatctgtcactgtttgtggcgtcgctagtgacccgatacgaccaagccctgtcttgccatcagcattcggaattaatggcgtcacatcagtcagctgaagtgcttccgccaaccaatcattcatgccacctgctgctgcatccaaatttgtgtgcgccgcataaacgacaatgtcatgcttaatcaaatccgcatacatcttgttttgtggaaccgacaaattcaaattcttcgctgggcggaaaatcattgggtggtgtgcaaaaatgaaatcaacattattcgcaatcgcttctgccacaacctctggacgcacatcgagtgctgtcatcactgtatgaatctcttgatttggatcaccaagttgaagcccgattggatcacgttcccaagctaggtcacgtggtgcataggcttcaatcttggcgattaactcagttgctttcatagccccaacgcctcactaatttcagttacttgttgttgatactcacggtatgcatctgaatcttgcttgttagctgattccaacttagccatgattgtctttacacggtcatattcacgttgccaattggtttgccaagcttcaggacgcttttccaagttgaatggtccgaacttcaactctgtttcagagtagtcggcatgaccagggactgcaatcaagacctcatagaaatggccgtcatcttcaacaaccgtttcgtcttcaagttgataatcattatccatcaaccaagtacgtacgacatcgatatcgatgttcggttgcaaaatcaaacgttggtaacgttgcccgtctgtgtgaccgtccgccaggatttgtgcaatcaagcgaccacccataccggcaatcgtgaccgtatcaatcaaatcttcgggcgtgacagcagccaagccatttgccaagcggggtaccaaaacatccccaaggcggtgacggttaatttcagtttggacattgtccagtggtccttgtgccacctcacccgcaatcgcgaatgaaatgtgcttgttcaacaacaagtttgctggcaaataagcgtggtcagaaccaatatctgctaaacgcgcaccatcgcgaacatatgacgctacagtcgccaatcgtcgtgataattgcaatgcatccatggcagtgtcctcgtttcctaatatgataatattctaattttagcacaaaaaacgccggtctgctaaacgaaccgacgttttcgatatggttttaatcttcaatcttaatcgctgacttcttagcgacttcagccttaggcaacgtgatgtgcaacaccccgttcttgtacttggcagaaaccttctcacgatctacgtttggtaggtagtaagaacggccgactgaaccaaagctgcgttctgattgcagaatgttcccatccttgtcagagtgatccttgatttcgtgacgcgttgctgaaatttgcaatgtgccatcttcataatcgaccttgatgtcatccttatcaacacccggaatgtcagcaaccacttcatagtgatcgtccttttcaacaacgtctgactttacatcagccccaaacgctggtgcttgcatcaatgacgcgttcatcttatccaacaaatccccaaatgcgtcgtgacgacgtagcaaatcatgtgacatagttatgtatcctcccgtaaatacaaaatatttttctctatggttcttttgtatcacgtcagaccaatggaattaaaacgatagccctcaaggtcacaaactgttcaggaaattgatttttcaatgaaaaaacacgcaatgaccagcattacgtgttctaacttatattctattgttggctgtcgcctggctttgaaccaagtgtccaagtcaaaacagcctcataatctcccttttgggctgcaccgcctggcacatgcaacgttacagcatccgtttgatcttttttgataaaacgagttagccacgttgcttgttcaggactggttgatgacgcaacattcatctcggtcttgtcatcaaaattaagttgttgaccagcaaagttcgtctttaccttagaaacatcgttatccttcgatgtcgtcttgacgtcagatgacccgaatgtcatgtacgcacctgacaaaacactctgcgtcgccttattagtcattggaccagccttcacatctagcgtccagttgcctgggtcagtacgcacatcagtcacctgtgcaaacaacggcatatcaccttgactcgtcttcaaatcatcagccgcataagtcgttgtgccactctcaatttcgtgttttccgaaattaaaatcaggcacataatctagcgacaagccatttgacgtgtttagattttgcttagtagatgtaccattggttggtataactggctttgttggatcaacgacaccgtttgcgcccgcattcaatggcaaacttggcgttgggtaatacgtcaccaaatccttgtggtcaccactataggttccagtaacagtcgccttatcaggtgtgaatccaggaacagttggtgtgtcctcagtgtacgtttgcccgtcatcaccagagtcgtctttcttgttgaagtaaacacctggttggttagcaaactggtaatccacgtactcggttgacttacggttatatttcaacgtaaatgtttgttcgggagtgcgcgtgacagtaaagatttggtagcctttaccatttccaacataaccatatcccgcaactttaggcaccctataaacataagcggactcaaacaatggatcgctcttagcggcggctagaccctcggcagaatcaactacggtaatgtgcgtaccaacaactgcttcctttggagtctttccaaaatcgggttgtttaaatgctgctttgtcagcatctgatataggcgctccattaaacgtaacatctgcagttccaactgtcagcttgaactcatcggctgtcagccccatatttgacgtatcaccaccggtagcagcgttgacggctagtgacatttcgtgagcagttgtgattttctctgtccacgtgtgtccccaaccagtcgctgttagcgtacctgagattggaccgctttctttattctcatctgctttgtctggtgtccacgtcaacgtgacctcgtttgatccgtgcttgtttaactgcaccggataaagaatttctggatggtcatcaggggttagattgcggatgttatccaattgcccttttccatcagtacgacgaaacatcacaaagtttttgcctgggtaactgccactattcataacattcggatctccaaattcagtgttcccatcaaaacttgtatccgggtttgaatttggatccacatcccaaggttcgacgttatagtgcaaatcagcaccccaataaaaagcattgtcaaaacctttatcaccgtacatttcaggatgggcaagctttccgataccgaggtatccaccacttgatccgttatcaatttggtctggctcaactggtgccaaaataaatccaagtgaatctcccaaagtatttccaggctgatcaatgttcagactaccagtgaaggtaaagtcatgagacatatcaattgcacgtcggaacgttaaacttccaaattgcagtcgtttattttgtgtcagacttactgttttatccttttccataggcaacgcttgaccttggctcttaaaacctttggtgaagtcttcatatgacttataatccggttgcggaacacccaaaacagtttgatcagccaatgctggcttgccactcacttcatcggcgtttcctgtttgttgactattatcagcgtatatcggcgtacctatcgctgctaacggtgctaccgaccccaaacacggtaactgctaacaacaggccagacaggccatgtttagttgctttttgcattatattcatacctgaatccccttatacatatttatttaatttaagtttaatatgcaccgtatatgcgatattgaattcccgcttttttagtacgttatcctgcgtgctgttgtttatttttaatatttaaaaatctttatcgccatcatgtaaaaaaagccagaaccgtgactagttctggctttagctaaagattaaagaaatcgcatcacaagcatgataataatcaatgcgagtaaacatatcacaataattggcaaccaattacgccaccataaatcatgacaaatttgttgcttttgttcttttagaacacccgctactttcatttgcgactgtcgcgcaggtacggccttcaccaaatccgccgaaaccaaaattcggttaggcgttcgggttgctgctgagcaagtcaccaatgttaatttggaagtcatcgtatctttcacacgatcgatttgggtttctttaatcgtcgacttttggcgcaccagatagagataactgtggccgaggtatttcagataaacctcatcgcccactgaaacgttttgcaacgccccgaagtgcaaatgacgcacacccatattatgaccaatcagcacaacattgtggttttgaaccggccggtcaggaaacaatgacacagccccaaaactcagattagcatttgttaaccctgcaaatacattggtaacaagaccaacctttggaatcgccacctgaccaagcgctgtttttgactgattattattagcaaacggattaccgccgtcaaacgcatgaatcgtttcagttgccggtatacttttcggcatttgttcagtataagtcacccgttgattcatgattttgcttgtcacaagtgacttttgtaaaaacgtccaaatggcaaaccccgcggcaatcaaaactaacccaataatagcgtatttaatcaattgatccgttcgattttcgtgcttacttcgcattgtgactaacgatggtcatcacgtgaccttgcttctttaaacggcggtattctgactggttgacctcacgaacaatcttaacttgctcaccactggcactttcagccatttcttcaatcgtgatcttttcattatcacgacgacgctttagcaacaacaaaagcaacaacaaggcaatcacaactgcgatgacagctgctagtaaccagttaaatggcttaatcgtcacatcttgcttattcaagcgcttagctgtcgcaccagcaatcgtaaacgtcttggtgaagtgccaagaataacggtaatccgtcttttcaccaaacatggccgtcttgaacgcacccgtattatccttatccgcatatgctgtcaaatccagcttatacttacccggcttcatactcgttccatccccaagtggcacactgtaatcaaagttggtatttggtgccatttgcatgctgttatttttcgcctcatacaacaccttagacttgttcgccttcatcactttggcgtcaaccgcgaagttgttcaagtagatgccgtccggattctgcaaattagccgcaatcacatttcggtaattcacttgtgttggcttaaccgactttagtttcaatccgttttccaacagcatctggtctttatatggtgcatccgttgattcacgcatcaaaagaccaagttggaatgaataaatatttttgattgatgttccctttgactttgttgcttcgttagccttatcagcggctttatcagaaaaagttagaccaccggcaataatacctggcacttgtgcatttggcattgtgacatggactggcacatccttcgtttcgcccggattcaacgccaccttgtcaggcacgttcaccaaatctttcatattgtatttcaatgaaacatccggcttaatcgtgttcggtccatactcaacgaccccgttttgatttgtcgacgcaggtgccacgctcgttgacacttcaaccggttgcttcgtgttgttagcataaggcaacatcaaatcttctgatgcgccttgatccaacttaagattgaaaaaaccgtccgtcttatcaatttgattatccggcaaaactggcgtgacggagaacgtcaattgattagccgaaacaccagttgcaattaccaacggtgccgccatagccagaacagtggcccccaacaccttggtccacttagctgtattttccattcctctgttcctttcttctaagtatgtataaaacgaccgacacaattgtctcggtcgttttttattgattaattgaattaatcgatagtagttggcgtctcaccaagcgtccattgcaaagtcgtcgtgtacattttagccatcttgtcggatgcacctggtacatccaacgttacagatgggtcaactgtgtttgcacgcttctcaccattagcttgcgtgtcatcggtcttcaagctgtcatcattaccgaagcggataatgtgcgtacctgacgtaccgtttgtcttaccgtcagcagccttggcaccagacatgatgttgactgaagcacctggagttgtatcgtcagcacctggcttgataacaaaaccggcgcttggcattgagacatcagtctttagcgtgttagtcgttgcgtggttcaagttcttaaagttaatttgtgtggccttcaaatcaactttagttgaagtgtggaaattatccagttccttaactgacaaggtccaaccagcaaatgttccgcggttatcagtgatttgggcgtagtctgggacatacttaccatcaccaagcaattgagctgaagcgttgtacgtcttatccactgatgtgatttcttgctttccgaaatcaaatgatgacgcaaaatcaagcgtgattgggcccttagtaccagggttcggattctttccatcaggattttttgggtcaagtggcttgtttggatctgggttagttggatccaatggcttgtttggtgtgtctgaattggttggtgcaacaaactcaaccgttccctttgaatcgtaagtaattggggtctttgatgctgaatcatcagcgaatccaatcgttggtacaaccgtcatagctgccaatgctgtagcagcaaatagtgttaattgcttcttcattgtgttactccttaaaaattacatggggacattgttcaatgtccacgttaacgttgttgtataggcaaccgcttctcgtggtgttgatcctggcacatttaaaatgacatcgggatctgttaagacagtagttgtctgattattagctaggacctggttttcagatttcaaaatgtcatctgcaccccaaggcatcaaccaagttccggcaccctcacctttggttgcgttcatcactacggtttgatcaccagccggtggcaatgtttcatcacgcgtttgtggtgcaggcgtcaccatgcgcccaatagcatgtgacccactcaaagtcacagtggcacccgtcaacaccttagcgcgcttggcatcgtctgacttaaattgaacgttttgtgcaacccgcaacgaccaaccagcgtgagtaccgcgatcatcagttacctgaacataatctggtacctcttgctgggtaccgccgtcattcaccttttgcgccttcgctgcataacttgcatccgcattttgaatcgtatgcgttccaaaatcaaaattcgatgcaaaatccaacgaaagcggaccagccgtacccggttctggctgttttggatcaactggtccaactgggtgatttggatgatttgggttataaggtggcgtcacaccattagacggcgtaaaggccaccgttccctgacttggtagtgatgaacttgcgaatgtcacagttgacacgcctaatagagaaacagtggcaaccaaggcggtagcaaacagtttgtttcccattatgtgctcctcttaattaacctttgtcgtttgtcgatactttataaactgcgccaatccccggactagaatcggaaaataacgacttcatcttgcgcatcttcattactcctcctcatttagctcagacacattgttaagaatggcttgaaaaatgatttgaatgcattcgtgtcacgcgatagaacgcaagactgatggcgagcccgaaagtcgcgagcgctaatccaaactgttccacaaatgatggtgcacctgtatttggcaatactggttggccatgttgttcatttgctgccccgtagaatggattatgcgtgtcagtcggcttgaccacactatcaccaggatacgtataactccctgtaaatcgtgcaacgccttgtgtctgataagtcactgtgtcagtattagcttccactaaaactggcattgccatcgctgataccaacgcaatcgtgatcccgataacagttttcttatgcaaaacaactcatcccccttcaaaacaaatagctgattgtatttgtacgctatttatttttaatatgtacgttgtcattctaacgggaataaaaaaaggatgggtattatcgcttaaaaagaagtgataatacccatccggttgttatttttaaaatttagaaaattatagtcccttttcttccttaagttggtcgtatagttcagccatctcaagatcattaggtgctaattgcgtgtaattgaacaaagcttcttcagccaaagccgtttcaccctcttcacggaagtagaagtaagcaggcttcaagaagttaatgttgtccaagaagaatggcaaagcggcattccagtacttcgttgccatttcgaagtcttccaaagccgtgtagctttgtgccaagttccggtacaattgtggatcagcttcagcatcgtcgtcagccaagaactcgttcaacaagttgatgtttccaacgtggtctcccatggcaaccaacaagtttgagtatccaatcgtcaacgtcaaatcttctgggttgttctccaatgcctcgcggtaaatacggtcagcttcttcgtcctcaccttgtgcttgtgcaacggcagcagcacgcgtgtacaattgcgtgttaaatgaatcaaccgcaataccggcttgatacgtaatcaatgcttgttccaaatcgttcttgtcttcgtacaattgtcccaaaggctcgtacaaaccagcgtatgatggatcaagttcttgcaactcttccaacgtatcgatggccttgtcgaccttttctggatcaactgcgtacgtcattcccaattggaagcggacatcaggcgtcaaatcagcatccttgatttgctccaagtaacccaatgcattcgcaaagttacccgtcaaagcgtaggcaacaccgatacgtgatgcgatatccaaacctgagaagcgacgctcaccggccttcaacaagtcacggtagaacggaatagccgtctcataacgacccgtagcaaagtagaactcagccaaagcgaattggataatcgtttcttcaggtgctaggtcaaaggattcacgcaacttggcttctgccgcttcgtttagaccttcagattggtacaagtcagccaacaccaacaatgattcaatgtaagccgttgaatcaggtgaaatctcggctagataagtaatcgcttcatccgtcttatcttcatcaatcgcaatgtcagccaaagccgtacgcaattgatcttcgtcgggatacttctccaacaacttttggtatgcacgcttagcttgggttgagaatcccaaaccatacaattcttccgctaatgaataaatcgtgtcgtcatcatcataacgtaatgatgatgcgaatgacttcttcgcatcttccaattgtccaccagacaattcatcaagcattcgttctgcaaatgttgccatatgtaccactcttccttcttgtataaagtcaataatatatcatacataaaaagcgctaggaatgccaataaaaaggtacctagcgctaaatgctacttattttcagatgcagcctttgccttcgcgcgtgctttggccaacaaagcctcacgtgcagacagcttttgatcacgggtaacagcgccctttgacgctgccccacgtgcaaaatcatttgacttgattgttcccttgcccatcatgtctacctctttttcaatctcgttacttacattatacccgagattgccaaactacttcaaagagttgttcgtcaaattgataacattggcaactgatgcacccttaaccgtcttcaccttcaatgtgacatcgtcacccgcttgcattaacaacgcgttttgcatcttagaaggatccagcgtgtacattgtctcatcattttcaagcttgaaaatcacgacttgcttatcatccaacgtggcattggcgttaacacgcgcaaccttaccactgatgctttcagtcttaattgaggcatcgttagcactggccgtttgaacactaccagccaacgcattacggtaagcagccaacgcgtctgaggcattagcaccttcaccaatgacgttttggtccgcccccttgatgtaggcgtactcacggaaacgttcattctgatccatcattgaaaccacccaagttggtgtgccgtcaatgttcatgatgactgggtttgacccatgccacttgttttggggatgcaattgcttagcaaccttaatcgccccatcagagtccatgataccaacgttcttacccgtgtagaatgacagcttacccgtacgcgtgctaatcaatgagtatcccttatcagaatcagcatttgacgtcaccgttgtgaaatcatcaaagtatgaaattgaacggtcgttgttgaagactggcgttacaccactctctgaaccattttcagttggcttgatttggttcttgtgacggaagttaaatgcatatgggttaccgtaagcacggttcatacgcgttgctgcttctggtgacacacccgcatcaacccatgctggcaaatccttggtgctgtagaccgtcgtcttaccagtatcagcgttcgtcaatgacacgtggatatcatcgtacatcaattgaccagcccaacgcacattaagcaacgtttgtacccagtaagcttggtcattgttgtcgatttccaaaattggttcacccacttgggcgtactttggattacgcatgtaaatcttacgcgcgatattgtgtgagaaccagctagtctctgagtaatccagcttttccttcacaaagtgtgccgtgtcattaatatccgttgccgaaataataaagtatcctggcaatgtccggttcattaaccatgacatgaagccgttaaactcaactggtgccacgtagtatggcttaccgttgatatattgagctgacaaatcacccaaacggtacattgaagaatcaggcacttgagagaaagccttcttcatcatgttttgtgaggcttgggctgacaaggcgattggttgatcatccttagtcaagggggcttccttcttaaccgccgcttgcacagagttgtacattggacgaaccgtcaacgcttgtgaaacaccagctcccaatgaaatcaagaacgcgacgattggaataatgaacggccaaatcgtcaacccttcaaggctgatgtgcgtaccacgcttcgttacacgttgcacaacttgcgctgatgagccggtaatcaacgcccacacaacgacaattgccgattcaaccgcaaccggcatcaccaattgtgacaacgttggtactggcatcaaccagtacacataacccgcgttcaagattgtcacaatcaacatcgtaatccatgttaattttgtaatcttaaacttcaaagcccatatcaatgagattagggcggtaatttctaaaaccaaaaatgaggttagcataagaactcctgtaattcgtttgtgataagtttaattttagcttaaaccgccctgagttactagacgaaaaaacggacatccgcgtgggacgcccgttttgttactattcagaatcgtgctttgacttcaacttaaatgttggcacgtcatcatgtgcgtgtgcgtgtgtgtgaccgaaattaatttctggaataccgtgttccaacatgtggtgattgcggtgttcaaattgatcatcttcccatgccgcatccacttcttgccatgagccagtacgagccaaaatttcgcggtacttcgctggcatttgctttgacccaatcgcaatcaaagcatccgcatgggcttgaagagcctcactaaagtcagcgtgcggttcagcaatccaagcgaacaagccaattgtttccaattcaagttcttcgtaatcagttggcgcaacgtcaacaaacgtatctggtgcaatgtccattgccttaggcgccactagcatcttaggggcgacttcccactcgtaaaagccaggaacatcacgtgactttgacacttggttaatcgtgacaatgccaagttggtaacccattgccaagcccagtgaatattcgtctggtagtggctctttaccagataccatcaaaaattccgttaccccttcatcaggtgcatacggaaaggcaatgagcgcttgttggccaagcatcacgtcatttgcaattggttggggcacaatcagtgctttcatcatgttgtcctcgttctattaatcagctagcacatcggccatgcggttcatcaagtaagcctcggctgcttcgactgcatcctcaagctcttctgcatcatcttcagtaaagttaccaaccgcctcacgattgtgtaggttgcgaatggtcaacaacgttgtgcgctcgccatctgataaatcagtgtgcaagttcgccaaagccttggcaaccgccccatcgttagctggcaaatcagcgaacgccaagaatgagcgcataatcatttcacgctgtgcttgatagtcggcacgtacgtcagcttccggcaactttcccttagcgacttcggcctcctcgcgctcggaaacactatcaaggtagagtaccgttcccaattcaatgttaaattcatcaaaagtcatgccaaaatctcctgtgtaaaggttagtagtcttgttgcacttattgtatcacaggcaaaagtgctttttgaaattctgcgaccgaacggatacaattgagaaaacgacgattcggggtattcacaatggtaatggagaattatttcaaagacctgcgcgccaaaattgggcacgatgaaattattatgccaggcgtagctggtattttatacgacgaaacacgcacaaaagtactcctagagaagcgtggcgacggcgaaatcggttggagtctggttggggggatgcaaaatcttggcgagtcatcgatgacctctttgcaacgtgagttcaaagaggaagccggtatcgatgttgaaatcgctgcattggtcggcgttgacacaaacttccaccacgtctttccgagtggtgacaaagcccaaatcccaatgtttttgtttgaagtcacgcagactggcggggaattgcaggctgatggggatgaaacgcttgccttagagttcgttccgctcgctagtcatccaaaaatgtataacgtacaacaccaactcgctatcgatcagctaatcgctgaggttccgtacggttggtataactagaaaaaagcactggcagacgaccttaacgatcgcctgccagtgctttttaattacttatcttctgacaagaatgatgcaatttcatctggcgtatcaaccaattcgatgtgaatcaatccacgcttcaattgcaattctgtttcctttgtcaaacgagtggcttgcttcttagctagcttttctgacttcttcatgggtgaaatgcctcttttcagttaataaggttattatacgctattgttcacccgtacgtcgaatttgcgctaagtgaatcatcacccattcttcaatgcgttcaccaagcttcgtgtaggtcatgataaaccatgccagataaactaccaccaaaataccaaaggcgccaatctctgaatctaaaatcgagagtccgaagtgtcgcaacacaacattatccaacaacgtgaacaaaataggcgccacaatcaccaacgttagcgtcatcatcaacgtattttcacgattcgtttgtcgggcatcggcctttttgtactctaccaacgttaaatcatgtagttgagggatcgttaaaatctccgtgtctgcatgtgttaaggccgcttcatgcttcaagagcatcacatccgtcatattttcgccatccgttagcgtcaccaataattcagcacgacggcgtggcatcattgtgtataagtcggttgcgtcaattttttcaacttggtagccattttcaccctggaagtggaatacgatttggccgtcctgattttgaactagaaaaagcatagcgcacctccttcatgaaactttttaccttactttttctctgtgcgaaaaccattattaaccagaaaaaaggtcgtttcaatctaaaagttccatgaaatcggttacagtcccttataccatgcgataagttaatttactgcgtccgctaccttgttttgtgaccaccatttgctgtggaatttgttgtttcattgactcaacgtgtgagataaccccgatcaaacggccactttgttcgactgatgccaaggcttccattgcttgtgacaatgtggttccgtcaagcgatccaaatccttcatcaatgaataacgcatcaatcttcgccccaccggcccggtgttgcacgacctcagccatcgaaagtgcgatagacagcgctgcgataaatgattcaccaccagacagtgtgctcgttgaacgtaccttaccggcgtcttgatcgtaaatatcgatgtccaaaccgttttggttggcacgaccagcttgacggtttgagagcacaaattggtaacgaccagctgacaaattcccaatatagtgttcgttcgcataggccaacacttcgtataggaaactgcgcaacacatacggctcaagtcgaagattcttggtgttcaccccatcgacagcctgcgtcaacttaatcaaatcagctgactttgcggtaatcgccgcaatttgttcttccaaaccaacgaccgtttcgtgttccttgcgcaatttatccaattcaaattgcaatttagccttaaggtcacgtgcgatcgtctctgcttcgttagccttctcttgctggtcttgcaacgcgacaagatccggcgccgtttggtcaccaatttcagcagtaacggacgtcaattgttgcttattttcagtaacctgcgtgtcatacgtggcgatttcagcactcaacgtcgtaatcaaagacttatcggcatctaagcgcgccagcaaatcattgaaggctgtctcatctgccaccggaccggccgcgatttcagcacccaagcgtcctgacattgacgcaaattgctcattagctgccgtcaattcagccgttagttcggcttgacgggcttgcagtgcttggaccgtttgttgggcgctacggacggcttcttgcacggcttgttggcgcttttcaaatgtcgcaatttctgccgctaatgtttgacgctcatcttcatacgtcgcaacatcccctagctcaccttgcgcattcaattgtgccaacgcctcttgatcagcctgcaattggcgttcttgttcttgtaattgcgccgttgttgatgcaacttgctctttatacttaccaagttctgatgtcaaatcagcaatttcgcgggttgtcttagcctgcaacgtcgcgttctgctcaactgtagccttcacggcatcgtaccgtgcagttaccacctctgactcatacgtatctggcaataaatcagttgggaatacttggcgccaatcgacatacagcgtttcatatgactccgctaggtcgacctttgcttggtcaaacgatgtcttagccttcgcaaccgcatcttccagttcattaactgatgccttcacacccgcttcgtccgcgatagcacgttgctcagctgtttcagcttgttcaacggcagccatcgctaccttcaaatcttcgtacgtcgtttgcacagcgtgggggtcttcgttctcaccagtgtaaatctgaccgcagacggcacaaggttcaccgaccttcagctcattatgtaattgctgaatcatcacatcgcgacgaagcgctgccttggactcacgcattgcaaccacttctgccaatgttgtttgcgccgtggctaacttgtgttgtgcggattcgtatgatacttgtgtgcttgccaagctagcttgctgttgattcaaacgtgcctgtgcctgtgaaagtgatgcaatacgaccagcaaaaccagccaacgccttttgttgctttgcaacatcggctagtgctgttaaacgctcatttgcatccgtcatcttttgggtaacttctgcaacatgttttgttgtaccagcttgcatgtcatgcaatgccgtcaaacgttcttcagatgcgtgaatcgtcttttgtaaatcggcttgacgcttggcatttggtagcaacgtttccgtcactaacgtcaatcgctcacgttgcgcaacaactgccgtttcgccggctaccaaagtcgcctgttcttgacgtgcggttgcttcattcttttccgcttcgactaacttattagctgtttgcgccgcttcgtcagtcaaacgttggaccgttcgctttgcatcggcaaccttaaccactaagtcacgttgttcatttccccagtttaaaagcgctaagtccgcgcgctttgctgccacatcttctgctaaagtggccaactgttctgcttgtgcctgcaaagtttgttgacgttcaatcgcttgcgccaacttttgaccagcctgtaatgcggcttgagcagtcgtcaaaccggcgaccgattgctcatgaacagccgtttgttgcgcaaccgcagtttgggcgttagcaacttgagtggctaaatatgccacttgttctgttggtgttggggcaatttcagcaatgtttggcacatcccagctgacttgcttcagtgccgcccgcaactcattcgtcaaactttcaatctgcttgtttgtatccttacgttgattcttcaatgcttcagtaaacgcatcgaagatttctgtgccaaataggctacgtaaaatcgtaatcttgtcatcgctttgagccgccaagaattcacggaattgattctgtggtagcaaaataatcttgcggaattggtccgccgtcaaatgcaataactcttggacagtttcattaaccagggttgccttttcacccaaatcggcgatcggcgtttgcaaagaatcgtccacttcagcaaatgacacttcagccttacgctctgtcgtgtcatcatctgacttagcaccacgcttctttttcagttgttgtgttggcttacgggcaatacggtagtactgaccattatgctcaaaccagaacgtcaccgccgtttcagccgtcgtcggcgcgaactcactacgcatcgcttctggcttgcgatcacctgttccttcaccgaatagtgcatatgtcatggcgtcgaacatggttgtcttaccagcaccagtatcacctgtaatcaaaaacatcttggactccgtaaaacgttcaaaatcaacggtcgtatcctcatacggcccaaaatattcaagatgtaatttaataggtcgcatattatccctcttccgcttgtgaaatcgcaactaacgtgtctgacaccagcgtttcttgcatcgacgtcaacgattcccccattacttcttcatagaactgactaatcaagtcttcattcgagatatcatcatcgaccggttccggtacaacttgctgatccaatgcaatttttggcatgtcatactgcaattccatgacatccccgtaaatctccgtcaaatccgcccgcgcgtttgacgattgcgccgcaccttgaatgcgaatactaaagaagtttgcatgggcgcgttcatattgttggtaaaatgctggatcagtcaacgtttcaaacgtttcttgcaagacaatcaaatcctttgtcggcgcaattggatgccagcttgtcgtcacacctgcttcagttacatcaacaatgtaaacacccttttcagtttgggcttccttggtattgaacttaaccggtgaacctgaataacgaatcgtttttgttggactggcttcgcgcaagtgcaagtggcccaaggcgacataatcgaagtctgcaaattgtcccgccgtaatgcccttcaaaccaccgacacgtgagttcgtctcacttgtaaattcataatcttcgttgtctgaacctgtcacataatagtgcgttaccaaaatatggcgcttgtctggattaaagtttgcgaccatctcgggcacaatacgcgccatgacttgttcaatcgattgatagtccgcaatttcatcttcagccacttgatagtaaacacgcgcagccgttggttctaagaatggcagcatgaaaatttgtgcttccttagtttcgaccggcgtaaaagcttccgccaaagtcgtattgatgtacaaattagtttgttcacgccattcgtgaccggctcccagacgcgttgccccatcgtggtttcctgagactgcataaattggtaaatgatgcgtcaaattcatctcgcgtagcatcgcctccaatgccgtcacagcacttgtcggtgcaatggcacggtcatacaaatcaccggccaaaataataccgtcaacctgttcatccagtgccaactgtaaaatcttcttaaaagcggctttctgttcctctaacaatgagaagccacccagttctttaccgatatgccaatcggcagtatgcaaaagcttcataagccttcctttcatgcacaattagaaaaaagtggtccaatcaccagattgaagccactttttgtgtttttagagtgtatccacaatttcgtcgaaacgttgttggatgtagtcacgtgattgcaaaagcttttcttgctcatccgtcgtcaaatcaagcgtcgtttctgccaagacaccatcgcgaccaataatcgctgggtatgacaagtacattcccatgtcatcgcgacgatttgagacaaccaattcagcatgcgcgtcagccataacagccttggcaatgcggattgctgacgttgcaacaccataactcgtgtagcccttaccattcaagaccgtgaagccacccttacgtgcttcctcttcgatggccgccaagtcaatatcgccggcatcagccaacgtcacgattggttgacccatcacgcgcaccgttgaccaagctacgaattgtgagttaccgtgctcacccaagttgtaacctgaaacagaacgtggatccaaatcaaacgcctcaccaactgcacgttgcatacgcgccgtgtcaagcaaagtaccggttccgataaccttgtgagctgggaaaccagtcacgtgttggaacaaggccgtaatcacgtcgaccgggtttgaaatcacgaccaatacgccgtggaaaccagattccttcaagtttgtgccgactgattgcaccatgctgctggtaaacttcaactcagcaaaacggtcaccggttgggttgtcttgttgcaacttgatgttccccagtgttgaaatcacaacatcagcatcagccaaggctgcccaatcgttaatcacaatgttaccgtgcgtttccaagttcgccattgcgtcttggaaatcaatttgatcagccttcacctttgcttcgtttgcatcaataaagacgtagtcgtcggctacaccttgtgcaatcaatccgtgcgctactgcagccccaacgtttccaaggccgataattccaatcttacgtgccataatatcccccaaattgtttttgtcgtatgttcattatacaaaaaagagacgttgttcaccactgaacaacatctcatcattattttagtcaaacaaatgcttagtcatcgccatcatcacggcagcgacaatcatcacaatcaccaataccaaataaacgacgttttggatgaccccattcggatttgcggtaaaagccataccataaagcattggaccgaatgcagacataaagtaaccaccagcttgcgccatacctgacaaacgggccgtttcaactggcgaagatgtcttagcagcaaacattgtcatggtgtacaaaaagaagaatgacgttgcgaaaccaatcaaaatcgtcaagaagaaccagtacacaactgaagacgtttcttgatcaaatagcatcacggcagcgactgcgatagtcgccaatgtccccttgcgacgcatgtttaccagaatatttggcaccaaaattgaaattggcatcccgataaatgaatagaatgacataatcaccgagattgatccggctgaaacatgatgctgcgccatcatggttggtagccaagccacacccgtgtaattaataatcgcttgtaccccgaatacaaccaagagtggccacgccttaatgttggtccaaatcttcttcttgggtgtgttagcatcgtgatgacgaccacgcgttgcaggcactttttctggcacacgcattgacgtgtaaatccagaatccaagcacgatggctggcaacaaaactagtaaccacatgacagcgtgccaaccgaacgttgccaccaccggcgccgtcaacaaactaaatgtcgctgacccgatcataatcgtgagtgagtacattgatgtgtatacacccaccttatgtgagtaatatgacgcgacgaatgtcggcataaagacgttcaagtgcgcaattcctgcaccaaccagaaccgtaccaatcagcatcgttggcatcgtcacgaccaagcgcaacgctgtccccaagaagattgatgccaatgacaaccccaacgcctttttcaagccaaagaacgccatcgtctttgacgcaaaattagaaatcagcaggaacataaccaacggaatcgtcgtcaagataccaagttgtcctttatcaacacccaactcacctgaaatctgcgttaacatcaaggggagtgtcgtaatgggtgatcgcataatcaagccaatcaagaggacacttgctgctaaaattgcgccagttgacgctacttttttattactcatactcaccctgctttcaaaaacgtaaaaaacctagatgtctagaatatcattttttcgggcagtaaaaaagccgtcatccgacgaaatgacagcttttctgtattatttacgcaacaccttgcggaatggcacacttagcagcaatgctagaataaagccaaccaagacttgcatgatatttgccggtacgccagtcaagcttgccaaagctgcgctcggcatagtcatcttggcgccaccggttagccaaatcaagaaagcgccggcaatccagtaaccaacgaccatgaccgaaccacctaagaagttaccccagacacgcttgccgatgcgttcgtccatcgcaaacttaccaagcacccagccttcaaggccgtgaataatgaatgaaaaaatcatccattgtgggtaaccagctagcaaatcaagcagtaagcccgtcaatccaccaacaaaagccccagtttttgaaccataatgccaagccgcaatgaagattcctgtttcgaccaatgacacgaagccagttggcgttggcaacttcaccacgtaactcaacacaatattaacagcaataataaccgctgcaatcgttaattgctttgttttcatgttatttaccccttaaacggcgggcagcttgccacacattaccaacagaaaaatcatcgtttaatgcgacaccgtttttaattccccaataaacaaaatctttagcatctttcaccgcgtctaccggcgttttaccggtcgctagttgacttgcaatggctgaggcaaatgtacatccggcaccattgttaaacgcactgtcgagcttctgagagcctagaaaggtaggttctgccccagtcgtgacaacatccgtcgcctcgttaccagctaagcgtgccccaccttttacaacaaccgcgtcagccccgaaaccacgaataatttctgcagcttgtgctaaatcggctttattcttaatcttaatgccagccaacaattcgccttcaaccaagttaggcgtcgtcatagatgcaagtggcaacaagtccttttggaaggctgccaccaactcgacaacatccacatcgtccgtttctttaaaagccatcaccggatcaataatcaccggcatgttcgtcgcataccgacgtagataatccgccaccatgtgtacgtgaccgacagtcggcaataatccaaccttcacaccagcgatatcatccaaagcgaaaattgactgtagttgcgcatcaaggacatccaacggcacgggatgaatcgtaaagtcatccttagtcaccgtaacaatactcgtaatcacgctaagcccaaaatagccatactcattaaaggtcgccaaatcagcctgtatcccaccgccggctaaaatatccgagccagcaatcgtcaccattttctttggattctccatcaacttcgcttcccttcacaagtcatacatgtagtttatcacagaatatattgtcagagtatggagaactgatagaaaaaaagagatgaaccaataggcgcatctctttctcaggaagtcttacttcacggcatccttcaaggccttaccaggcttaaatgcaggaatctttgaagctgcgatttcgatttcttcaccagtttgtgggttgcgacccttacgagcagcgcgctcacgaacttcgaagttaccgaagccgatcaattgaaccttttcatcctttgcaaggaattcttggattgcggcgaatactgcatcaacagcttcgtttgcatccttcttcgtaaagttagttgaaagaacaaccttttctaccaaatcttgcttgttagccatgctaatgttcctcctgcttaatagcttaatggaatttcccaaatgtacgaaattgaacgaatcgttctttgatttcgttatttagaatagcatagttaaaaccccataacaacccataatgtgctaaaaacgttgatataacgcggtttttcccacattttcacgttttattcactgaatgtttgtttttcagtacttgcctattgttcggtattcttaggtatgcatccaaataaaaacctcatagtgaaaatcgctacgaggtttttatcatctattaagtacgagcacgcttaatcaagtgaattggcgtaccagtaaagtcgaatgacttacgaatttggttttccaagaatcgtgcatatgagaagtgcatcaattcaggatcattaacaaagaccacgaatgttggtggttggatagcaacttgagtcgcgtagtaaacacgcaagcgctttccgttgaccgttggcgttggattcaatgccaaggcatccatgataacttcgttcaacgttgctgattgcacacgcttttggtggttctcgttaacttgcttaatcaactctggcaacttgttcaaacgttgcttcgtcttagcagaaacgaaaataattggggcgtatgacaagtattggaactcatcacgaatttgcttttcgaagtcagccatcgtgtggttgtccttctcaagcgtatcccacttattaacgacgatgataatcgcacgaccagcttcgtgggcatatccagccacgtgcttgtcttgttcgcgaataccttcttcggcgttcaaaaccatcaaaacaacgttagaatcatcgatggcacgcatggcacgcataactgagtacttttcagtattctcatataccttaccacgcttacgaataccggccgtgtcgaccatcacaaattcatcaccttcagcagatgtgaatcgcgtgtcgatggcatcacgcgtcgttccagaaatatctgaaacgataacacgttcttcaccaaggatggcattaaccaatgatgacttaccaacgttaggacgaccaatgaatgagaagcgaattgaatcgtcttcttcttcttgatcagtcgttgggaagtgagaaaccacttcatccaacaaatctcccaatccagtaccgtgggcaccagagattgggaatggatcgccaaatccaagtgcgtagaattcgtagatttctgaacgcatctcgatgttatcgaccttgtttacggccaaaacaacaggcttctttgaacggtacaaaatctttgcaacgcgttcgtcagcttcagtcaaaccttcttgggcagaaaccatgaagataataacatcagcttcgtcaatcgcaatttcagcttgttgcacaatttgtgtcatgaatggctcatcagccatatcaattccaccagtgtcaatcaaacggaattcacgggtcaaccactcagcgcgtgtgtaaatacgatcacgcgttacacctggggtatcttcgacaattgaaatacggtcgccggcaatacgattaaaaatcgtagacttaccaacgtttgggcggccaacaacggccacaacaggaaatcccatgttaccctcttttctgtcagtcacccaaatggataactaacggttacttactattctctattgtaccggttttcaccggcactgtctgttgtcgtgaccagtagaaaatcgtgttttaacgaaattaagcgtgcgttgagacaacccaacacacgcttaatcttttgcgctatttaaagcttattagttgaagtccttgaagatatctccaaaggcgtcacccaacgtagctgaaccctcttcttctgaagttgagtagttagttggtgcttgctcttggcgaggacgacgttgacgacgaggacggtcattgttgtttgaaccttcttcgcgtgcaggagcctcttccaaagccttgattgacaatgacaaacgttgcttgtcagggtttacttccaaaaccttaaccttaaccttgtcaccggccttcaaaacatcacttgggttagcaatgtgcttgtgtgagatttgtgaaacgtgaaccaaaccttcaacaccagggaacacttcaacaaaggcaccaaagtcaacaacgcgctttacagtaccttccaaaacagttccttctggagcttcagctgctgctgcttcccaaggaccaggttgcgtagccttgattgacaatgagatacgctccttttcagggtccaatcccaaaaccttaaccttaacttcttcaccaactgacaaaacgtctgatggttgtgaaacgcgctcgtgtgagatttcagatacgtgtaccaatccgtctacaccaccaaggtcgatgaatgcaccgaagttagtcatgcgggcaaccttaccttcaacgacgtcaccaactgacaattcgttgaatacgcgtgacaaagcttctgaacgctcttcgttcaaaacgtcacgacgtgacaagatcaagcggctgtcagcagcgttgatctcgataatcttcgcgcggatagtttgacccttgtattggttcaaatcttgcacgaaacggttctcgatcattgaagcaggtacgaatccacgtacaccttcaacgtcaacaaccaatccacccttaacgacttgcgttactggtgcttccacaatgtcatcaacattgtgcttgcttgcgatttcttcccaagcacgacgagcttccaagcgacgctttgacaataggtatgatccaccttccttgtcagaaccgatagttgatacaactaccaagtccaatacgtctccaaccttgacaaggtcgttaacgtttgcatcacggtcagccgtcaattcgcgcattgggataacaccctcaacaccggcaccttcgatacctacgataacttgacgagcatcgtcaattgccaagacttcacccttaactacatcgccaaccttaacttcggctacgctgtcaagagctgccaatagctcgttgttctcttcgttcattacaatatatcctcctggtcacacgactctagtagttattataccgaatccttttataaattactagtagtcttttacaactttctttatgttttttgttagttttgcgtcttttccgcaataatggccttaacagcgtcaacgacaccgtcaattgacaaaccagtcgtatccaattcaaccgcatcatccgccttcttcaaaggagaaatttcacggtgtgaatcaagatagtcacgcttctcaatggctgcttcaagctcttcaagtgatgtgtccatccccttagcttggttttccttaaagcgacgttgggcacgctctgccactgaagcaatcaagaaaatcttgacttctgcatttggcaaaaccgtcgtgccaatatcacgaccatccatgacaacaccattctctgaagcaatgtcacgttgcaaggctgtcattgcttcacgaacagcggcatatgaagaaacagctgaaacattagccgttacttcgactgaacggatttcttcagttacttcttgaccattcaagaaaacacgttgcactggctcaccaggttggaacgtaatggtcaagtcaggcaacaaagctgttacgcctgattcgtcatttggatccacaccggcttgaaaagcagccaacgtgattgcgcggtacattgcaccagtgtcaacgtacacaaaatttaagtctgatgccaaaatcttggcaatcgttgactttccagcagaggctggtccgtcaattgcgatttgaatcggattcataatcaattgtcctcactcatttagataccaactaattgtacgttaatttcgcacaaaataaaagacacactcccagcggaatgtgtctttttgggattacttaaccttcaaatcttgaccatagtaggttgaataatttgaggcagtcaatcctgggttcaatgagtacaacgcttcaggcgtcgtcccattggcaactgcgaaactgtacaaagtaccagattcaaacttcaccgtattaccatcagattctgaactagaacttgaggctgatgaggcttcagatgacgaagcagctgactctgaagcagctttgcttgacgcttctgctgctgattggcttgctgccttggctttcttctcagaagcactagccgccttcttagcgcgtgactctgactctgcagtttccgtaactttgctcgttgtagtggttgtctttgttgaagtcgttgctggcaattcagtgctagttgtggcatcaactggcttgttcaacgcttgcaaatacttatagacaggcacaaatgacagagcaatcacaatcaataccaaaatcccaacaaccatacttacgcgttgagacttgcgtcggttttgcgttcgtgagtattgaccggttgcttcatctttaaaagatgcctcccatggctgttgttcattattcttctcggtcatgattggtctcctaactttctctctttgaatacttctaagcatacactaactcgcattcaattttgagtgtcacacctaatccttaacctaaattaaaaagttttgcgacttgcgtgcgccaatccgtcacacctgctagttctgtaggcgcttcagttgccaccaacgcgagttcttctgggtgccaatctacgacaccaacagactcagcatcatcgttagactgtgcatcatcgccgaagtgatctagtaattgacgtcgcaacccggcgtctgacttcgcgtaattaacgagattgtacaaatcttgttgacgttgttgacggcgcgtttcaaacatcgtcgcaacctcatctggattcataccttgctttgcgtaaaaatcaagcaagtttgccttgtcacggccaatttcatcggcaccgaaacgcttatcatagtaacccatgacaacttcgcggttcggaatcgtaccgtcgatcatgttaagttgtagattttcgtcaccaggcacatacagcaagatggcagccgattgctcaccatcacgaccagcgcgaccgatttcttgtaggtaattagccaagtcattactcaagtggtagtgaatgacatagcggacattgtccttgtcgatacccattccgaacgccgacgttgctgcaataacatcgatttgccccaacatgaactgttgttggatgcggtaacgtgacatcgtatcaagaccagcgtgataagcagcgacacgacggccggtattctcagccaaccaatccgccattgacgttgccaacttgcgacttgagaagtaaacaatccctggtccttgtagttggcgaaccaaatcagctaagcgttcacgcttctggccttcgttcgctagcgtttccgtgtgcaaatagatgttcggacggtctacagattgacgatagataaaccaatctgattcaggcaacccaaatggtaccgtgatatccgtcatcatctttggcgtcgcagttgccgtcaacaatagcaattgtggttgtccaagcttcttgtggacttgtggcaaagccaagtaatctggtcggaaatccggtccccagctaacaattgtgtgcgcttcgtcaacgactagcaaattaatcttcaccttacgcaaagcagattgcacaacgttttgtcccaacatttctggtgacacaaacaagaacttgtattgatccaagctacgcaaaatcgtacggcgggcatcctgtggcaacgttgaattcaacgcgactacctttggttcaccggcgtaatttaaacgcgcaacttgatcttgcatcaatgacaacaatggcgtcacgatgatgaccaagccatcacgcatgttacccatcatttgataaatcaatgacttaccaccaccagttggcaacatggccaaggtgttttttccagcagttaatgcttcaagcacttctgcttgacccggcttaaatgagtcgaagccaaacttttcttttaaaaccgcagtcaaagctgtcttatccacgagcggcctcctcttgcttcgtcaaataaatctcgtacaaacggaataggaagaattcgagtgggtcgtcagatgtacgaaccatactaaactcccagtcgttaatcggaccggttaggtgttgttcaaaatgtgcaaccacatccggtgtcaaatagttcttatatggaaaatcattcattggtagccaaattgccgcggtcaacaagtgttcgcgaatcgtaccaatcttcaaacgacggctttggaccatttcatccattggtcgaccagcgataacaccgttgtatgaagcttgcacactattaggcaataatgggcggtgcgcaaccaaatcccacaacaacttcaatggcgtgttggccccacgttgcaactcttcagaccaaatggcatattgatcaatttgccagaaatagaagtcatcttcggtccaagttgccgggaatcccaattgctcaaggttaagtcctggtgtttcgtggccgacccatgttgcaaccaaacgatctgcatcttcttgtggacgacgttgcaagaatcgttgaatcgtcaacgcccaagttgcaaccaagcgtggtgaattcatattgccataccacgtcttaaccgtcagcatcgtacgtggatcaatttgcaatggatagtacttcttattgctgtacgccacttctgaaaccacttgatttgccaaccaaaaggcttgcataaaggtcaacacatcgaccttaagcaacgtgctcaaatgctttggcatatagtgatttgcggcatactcagcttgtgcttcttgaccggctggcgtcaaaacaagttgaccttctcctgactcagccagcaatcctgcttgctccaatgcggcaatacgggcatcaaatgtgtccttatctaggcgaggcatcaaacctgaaatttgcaacaacccatagcgcaaaccccaatattccgttgacactgtcacctgacgcttcaataaaccaaaaatcaccctgtgacgacgaggttcagacgccgaaaacagggtgatcaagaaatcatttgtcaactgcttgaccacctctcatgtatttcttccaagtgtaatgaagaaaccaaaacggtgcaagcagaataggacttatttaattaagttgtgagcgggtcgtgttaataatttgacgcaaccccaaatagaccaaacctgagacagctgtcagaatagccccttcaatcaaattgaacggaataaccatccataataggtacgttccaagaccaatcgtcttcgcaatatcaaagttggcaaacatcgcatatagtggcactgcatacacgtagttcaaaatcaccatcgccactgttagaccaagtgttcctagtacagccccaacgacatatcgcttcggtgacatatcttgacgcttcacaatcaccatgatgaccgtcaacaagactgccatcgcaataacgttcatcggcaagccaatgtagtcgttcacgccttcgttattcaacagtagcttcaatagtgaacggagcaataaaatggcataaccacttttcaaatcaagcatcaacgcacccaacaagacaggtacaaatgaaaaatcaatcttcaaaaatgatgccccaggaattaatggaaactgcggaaaaatcatcaaaacaaatgatatcgcagccaataatgcaataacggtcaatcgacgcgtcttattcataacaacaaacctccacctggtcgtaaaaacagccggttccttcgtgccagggcgacacaaagaaaccggctgtgaccagtcaatctattttttcttctgcataccagactttactgtcggtcacggattcacaccgtgtcagccacaccaataacggatgcgggtcgcggacttctacaaaacgcagttaccgccggtcgggaatttcaccctgccctgaagatattcaattgtaggttaagactatcacgcgactaactaacggtcaaccgtctaggtcaaccttgtgacgtagcttgtcataggcgtgcttctcattattcaacaaatcatagatgcgacgaatctgtggggcgaaccacttcaacgtcaaatcttgggttccttgcaacgtttgaatttgcaaacgaccacgaataatacccgtgtccggattaatcgtgttcacttgatcaagcgtcatacgcaaagagtccaaatggaatggccgccaatgcgcaaaatacaaagtcccggaatcaccaagcgcaaatgcataccacttgaagcgaccagtaggttctcccgcgtcggtcagtccagccattttcgttaagaaagcgaccacaaccgtttcatcatcagcaagcgaattctcaatattcttaaaatgcttacggccaagccagcccatcggcttcaatagccaaggccaaccggcaactttgtgttccttcgcaaaggcgtacatgccagggccagttttcatataattacggccagaacgtgtatctggtgttgccatcttgcatcccccccattcatatttcatcacaatcactgtgaaacgtttctgtgaagcaatcaatcatccttcacacttcttcatcttactgtaattgtaacaaaagtcgagcggttacatgtcctggatagctcgaacgtggatgacattacgcaaaaatagccaaccacctgaaataacaaagaccataccaccagtaatcggtggccaaacaaatgccaagccagtaccaatgagaccgatgccaatcaaccaaagacgactgcgattaacgcgccacattcttttttgttgtgccggatcatccaaatgcttagcgataacgtggctcaaattgtataaagcaatcacggacatgacatacacaataccatacgtcacactcggtgccacacgggttgggaattcaccaaaccaagctgtcgtaattggcaccaatgacattggcaaaaacgtcaaggcattggtccacaacacaccactatcccctttctcgatattactaataatcaagtggtgactaacccaaaaactagccgtgataatgaagctcattaagtaagccaagaatgtacttagccacgcagcattgccaatccccgcccacgtaccgattgacggaattttcaaatccaacaccataattgtgatgatgattgcaaagataccatcactaaacgcttctaatcgacttttactcataaccttcccctttatcgacaaaaaaagaggcctccaggaagccccagacgcctctattatagcttaccagcgtcctgctgacttgcggtattgctttccagccttcaacgcttgtacttcttcgtaacgcaaaggacggtactcacctggtgtcaagccagtcaaatcaagcataccgtaacgctcacgagtcaacttcaagacttcgtgcccgaccgccttcatcatttccttgacttggtgatacttaccttcgtgaatcgtcaacttcacaatcgccgtgtggttctttgtgttcgttgattggatttcagcacgagcaggtgcagcgttgaatgtcgtgtaacgaccgttttgctttgtcttaaccgtgacaccgtggcgaagcttttccaattcttcattcgttggaatgcccttaaccttagccacgtagaccttgtcgatacggtaacgagggtgcatcaacttgtttgccaactcaccatcgttcgtcaacaacaaaacaccggtcgtatcgtagtccaaacgaccaactgggtaaacacgctccggctcatcaacgatgtccataaccgttgcacggcccttatcatcactatttgtcgtcacaacgccacggggcttgttcaacaagaagtaaaccaacttttcgcgtgaatcaattggctcaccacttacttcgatcttatctgatggttcaaccttggttcccaattcacgaaccgtcttaccgttgaccgttaccttaccatccaaaatcaattgttctgatgcacggcgtgatgcaactcccgcttgagccatcactttttgcaatcgttctgccatattcttaatctctttctgctgtttcagcaagttctggcaaggctacatcaaatgcagacccgccttcttctcctggcatcaaaggcaatgccacatccttttgggcacgcaaggcatctagtgcctcagcggttaccaacggtggtaactcttgcaaatcactcaaaccaaagtagttcaagaaatatgccgttgtcccatacagaattggtcggcctggttcattagaacggccacgtccctctaccaaattacgtagtgctaatttttgaatcgttgcctgtgattgcacaccacgaatttcatcaatctcaacgcgcgtgattggttgcttgtatgcaataattgccaatacttccagtgatgcttgcgacaaggctgtcgtcaacggcgccgtaaagtaacggtgaatcgtctcagcaagctctgacttagtcaccagttgatactgatcatcagtcttcaaaacgtcgagcgcactattctcgtcgctctcatatttggcggcaagatcttctaacaagccaatgacggcgggctttgcgaaaccagtcgcatcagccatttccgcaaccgtgatgccttcatccccggctacaaaaagcaaaccttcaatttgttgtaagctagtcttcatcgtcaaaatcgactccctcatctgcagtttcgtcataaggtacatcacctagtgtcaggcaaattgcaccatattcatcttcttgggcaactcgcaaatgttgatgacggaccaattctagcatagctaggaaggtcgtcaccatcttatcgcgactatcatgctccccaaagaatgtttcaaattctattgtttcaccaggtgtcattcgtgacacaatggttttcatttgcgcgctgattgaccacgtttcaccacgcatggtgcgcggacgaacttgtttcttcgttcggttagcgaccatttgattaaatgctagctgcaaatcgaacaagccaaggccttctggcaacggcgcaacgtcaatatcgtccggaatcgccattggtgcacgtgaaaattgcaattgacgcccttcttcacgttcacgcaagtcatcagccgcttgttgataacgttgatactccagcaattgtgccatcaaggcttcacgtggatcttcttcgtatacaaactccgccaattcttcgtcatatgttagttcctcattcttcggaatcagatatgacgctttaattgacatcaacgtagcagccatcaccaagaactcgccagcgatatccaagtttcgttcttccgcttgatgcaaaaacgccaagtactgcgccgtaatttcaacaatcggaatatccataatatccatctcgttaactttgattaggtgcaagagcaagtctagtggtccttcaaagtcattcaagcgataagttaaatcttcagccatgcaaatacttccgccattccgtcaagattggttgcgtgctaatcgtgccaacaatcgttttgtcagggtatcgcaacttcatcgcctcatatatgtctgaaccgacagcaatgcgtgacgtaaccggtacttccggtccgaacacaaccaagcgcaacacgattgaatcaaataccgcttcaacacccaaaacagcaacgtaatgttgcgtttcagttgactgccacagcaagatttcacgcgcctcgcttgcttgataccactcgatttcacgttgcacagaagccacatcatgtaaacgtggcaagtatgacaataatcccatcgcaattttcggttgatctttgcgtaccacaactagcatgtgtggcctcctttcttaattaagcacgcggatgacttttgccatagacttcagtcaaacgcttatttgaaatgtgtgtataaatctgagttgtcgaaatgtcggcgtgaccaagcaactcttgcacaatgcgtaaatcagccccgttttccaagatatgcgtcgcaaatgagtggcgcaacgtgtgtggtgacacatctttcgtgatgcctgctgccttcacccaacccttaatcagcttccaaacaccttggcgcgtcaattgatgaccatggtcatttaggaaaatcacctgctcatcttgttgcttaccaaggaatggtcgtccgtcggctaggtagcgttgcaaccaatgtgacgctacatccccaattggaatgatgcgctctttgtcaccttttccaagcgtctgaatcagccccagttctaggtgcaaattatccaaacgcaaattaaccaactcactcacacgcaaacccgtcgcatacatcacttcgagcatggtacgattgcgcaaccccaacggcgtgtttgggtcaggcaccgccaacaaagcttcaacttcagtgagcgttaaaacagctggcaaatgttgcgcctttttaggcggatcaacttgtgtcattggatcaatggccacccagttattgctggtcgcaaattggaaaaactttcgcaatgtcgacaccatgtgaatgaccgtgttacgtgacttgccgtttttctctagttcacctagaaacgccataattgtaaaacgatcaatatttgccaacggcatcgacttttcttgttcaattaaatacgtaaagaaatgacgcaggtcttgctgataggatgcccgcgtattggctgacaacccccgctccaccgtcagatagtgcaggtagtcaaccatattatcttcatatggacctacctgatgtaacatcttattcgccgtcgctttcttctaccaagaacaagccgttctcgttttgcgtaatcttgcgttgcttgtacaagtttcccacagcacgcttaaattgtgactttgacataccaaagtacttcttaatttgctttggatctgacttatcagtaaatggcaagctgtgcgttgatgaacgttgcaacaacgtcaacaacatcgcagcgtcatctgaaattgcctcgtaagcgcgtggacgcaatgacaagttcaacacaccgtcttcacgcacgccgataacacgtgcatcaacttcttcaccaagacgtggttcgcgttgacgctcatctgggtgaatgaacccaaagttataatctggtgtgataaccaacgttccgaccatcttcaaacggtaaaccgttgccttcacctgcttgttcttaatatcaggcttagctgggatacgcacagcttgtaggatgtcagctgaggccaattcaccccacaaacggtccttcttatcaatgcgcaacgtaatcatcaacatgtcaccgcgttgtggccacaattccttaattgttggcaactcatccagtgacacaaccacatccttgtttggcaaaccgatattcacaaagacaccaaggtcacggcgaatatccgttacttcaccccatgcatagtgaccaagacgaacgtcaggaatattcttcgtaatttgcaagttgtgcttttcgttctcgtatgcaaatccagttacaacgccaccaatcttcaatggcttttgcaattcactcttgtcgatttcgtatgtcaaaccgtcaatttgtgcgtagtaatacttgtcgttctcatccgtcaccttggctgagatgatttctccaattttgtgtgtcatattattttctccatatatctctttgcatcagctgcatcaacctaaggtagtccgatgccacagcgctggcaaagccgttgttcaactgacatgccgtcagtaaacccattttctgtctactctagtttaccagaagttaggcgttatatgtaaactaattcgaattcatttctgacattttcccagagttttgataaaataagtagacatatattttattttgaaagtgagatacatcctatgaaggctgttggtatggaaccacaagtcttgatcgacatcttggtcggatcaaagattggtgtggtttacccatttggaactgatcaccgtggcgacttggtcgttacatcatacgcattgaagcaagctggtttgccatcaaacatggctggtgctgtcgtgcaacttgaagacgttgaagaaactgcacccggtaacttcgtttggaagtttaaccctgatgttaagttgattcgcccattccgcgttcacggaacgatggaattgttcgacgttgaaaatgacttgattcactacgagccaacgaactggttcaacgttgaaaaggaaaacgaaggtcacgctaagattgctgactggatggaaagctatgttgctgagcacccagacatcgaccgtatcccacgtgccgacattcctgaagacattgctgaattggccatttctttcgatgactggcgtgcagcttactccgacttcttgttcaagccaactaaggcgcaaaagcaagaattgcgtacgaagcgttacgacgttgacccattgtaagatataaactaaacaggacctgatgactcacagcgagttctcaggtcctgttttttaattctgtaatttttcttgaatcgcttcagccagtgtttgggaaaagttaatccccgcctcgcgtcccatgcgatcaattgcatatggaatcgttagtgtctttttaacggggcgattatcgcttaacgcaatgtactctttgacgtttacatctactaacgttacaacttcatcttcagttgctattggcaacgtatagacagaatccggcaaatcttgaccgtcgtgagctaactcaaccgccatttctccaacgtattctcgcgccatctcgattgcatccgctactgactttccctgtgtcataccattaaccgctggaatttctacaaaatagtaatcatcatcggtctgtgtgtgcacaataatcggataaaccactgtatccttcatcgaagccacctcctaaatcccatgtttcttgaacaacccttctccttcattttaatacgtaaaaaacacgtatacaatgtagtttttacgcttcgacaagaaagagacagataagctaattttttccaattttatttaacttttgcaatcaacggacgcatcatcaacggcgcaatgattgttgaggcaatgattacgattaccatttcaccaaacacctggttcgacaaaatgtggccagttgcaccgatttgggcaataaccaacgccatttcaccacgtgaaaccatccccgcgccaattgcgttactggtgtacttatccagtcgtgccatacgcgcaccgaatccagcgccatagtactttgttgcgactgccaaggctgttagcaaaatcataatccaccatgtttcagccaggttattaaagacgacgttcaacccaattgatccaaagaagattgggaacaccgtccattcaccaaacaattcagtcgtatgcaacaacttatctgactttggcagctgacggagcaacacaccaatagcaaacgcaataattggcatcaccgtgtttaatcccagtcctgatccaccgataaaagctgcataggccgtcaccaatagcaacgctaaaatatcatctagcacggcggcgcccaacacaacggcgcccataacagttccaagctttccttgctcacccaaaactgaaatggtaattgaaattgacgtggcggcgaacacgacaccccagaacaacgcaatttgccactcgtaaccaaatagcaaggcaacaaccgggaataccgctaacggtgccacaactcccatcaaagcaacaaaattagatgccttgaaattttgcaataattgacgcgcatcagtttccaaaccagcattcaccatcagcaacatcaccccaaattctgagacaacgtgcatcaaatgtgatggggcaaccaatccaagcagtgccggtcccacaaccacaccggcgattaactgtcccacaacttttgcaaatcctaacttgccagcaatccaaccaaatcccagtgtcacaaccagtaatcccaacatcattactatttccatctctacctcctacaacttacttaatataagttcaacaaaaacaaaaaagcgcacactccaaattcccctggttacccacccaggaaacttgaagcatacgcccaaccgaaatctctattcacttctacaaattattgattgcgtgagaacaagttgctaaatggtgactcaccagtgttcgcaacttgcgtcaagaaaatcttgatggctgtttgagttgtcaaaccttgtgacttgaaaatctcatctgccttgtccttgacattgtcctcgacgcgcaattgaatcagcttctctgccataacgatacttcccttcgcaattgtcttaatttgtatatctgtattgtagcacacgcgcaacagacaatactatcaatatcattgcatattactagggaattgtagggcgaaactatgacttttgtttgaccacgtcaaaattcatattatttattatcggtatcaaagataattgtaactggtccgtcattgaccaagctgactttcatatcagcgccaaactcaccagtagcaaccgtcaagcccgtcgctgccaattttgtattaaattggtcatacatcttttcagcatacgcaggtgcacctgcatccgtgaaacttggtcgattaccgcgacgcgtatcggcatatagcgtgaattgagaaattgacagaatcgatccgccaacatcttgaatacttaagttcatcttaccagcttcgtcttcaaagacccttaagccagtaatcttacgaaccaagtaatccaactccgcttccgtatccgcatcttgaatcgcgaccagcaacatatacccttgcgcgattgcacccaactcttggtcatcaaccgtcacactcgctgatgatactcgttgtaagacaactctcattacttaaatgctcgctttacttcgtagacatccttgacattcttaattgaatccatgatgtgttccaattgttccaagttgcgcacgccaacactcaatgaaatattcacattgttattgtgatcaatgcgaccgttaacaaagttcaatgacttcgttgtgttattcaccgtacgaataacgtcattcaacaacttgtttcggttagttgctgccacagccaagtcagcgtcatactcgttcttcgtatcaccttctggcttttcccaggcaacatcaaccaaacgttgaccttccgtttcagccgcacgcaagtttgggcatcccaaacggtgtactgatacaccacgacccttggtcacatacccgataacttcatcaccgggtactggtgtacaacagcgacccaaacgaaccaacaagttgtcgacaccttgaatcacaatccgatcctcaccgtgttgtggcttctccttcgacttcttgctttcgttttcaatcgtttggtgttcttccaaaatggctttttgttcggctgcttgacgggcttcttcaagctccgcacgcttttcttctgtgaacttgtttgctacaccttgaggcttcaaatcaccaaatccgagcgatgcatacatgtcatcaacgcttaggaagtgcaacttttcagctgcctttgcttcgttgtcagcttgcatcaactcttcaacatcaaagccttcctcagctagccaatcggcaaccatctttttaccagcttcgatgttgtcgtccttatccagcttacggaagtattgcttaatcttgttacgggcacgacgcgttgacaccaaattcatccaatcacgatttggcttggcgttttgtgacgtcacaatttcaacaatgtcacccgtcttaattgggtaatccaacggcaccatgcggtcgttaaccttggctcccgttgtgtggttaccaacattggtgtgaatgctgtacgccatatccaatggtccagcaccctttgccaactcaataacatcaccctttggcgtgaaggcaaacacgcggtccgtgaacaagtcgcccttaacagactccatgaagtcatccgcatcacgcgcatcttcctgcaattccaagattccttggatcacattcaacttttgctggtccgcattttggacatccgccccagcaaagttaccttccttgtatgcccagtgggcggccacaccgaattcagcgacttcgtgcatttggtacgtacgaatttgcacttcaagtggacgaccacccggtccgataactgaagtgtgcaatgattggtacccatttgcctttggtagcgcaatatagtccttgaaacgacctggcattggcgtccaacgcgcgtggatagcacccaatacggcgtatgtttcaggaattgtatctaccaagacacggattgctaacaagtcgtagatttcgtcgaacttcttcttcttgtccaccatcttacggtagattgagtagatgtgctttggacgcccgtatacttctgcatgttgcaaatgcaattccgtaattgcttgctcaatatcgttaaccgcttggtcaacaatttccaaacgttcttgacgacgcaattgcattgacttagcaatgtcgtggtaggcttctggctcaagatagcgcaatgacatatcttcaagctcccacttgattgtcataattcccaaacgatcagccaacggtgcgtagatttccaacgtttctgacgcaatgcgcttttgcttttcttcaagcaatgcactcaacgtacgcatgttgtgcaaacggtccgccaacttaacgatgatgacgcgaatatcgtgtgacattgccaacaacaacttacggtgattttctgctagttgctcacgtgatgacttatattcaatctttgacaactttgacacgccatcaacgattacagccacatcatgaccaaattcacgttcaacatcttctaacgttgcttcagtatcctcgacaacatcgtgcaggtaacccgccacgactgtatctggatccatatgcaagtcagccaagatgccagcgacttgaatcgggtgaataatgtaaggttcacctgacttgcgcttttgttccttatgcaagttgtaagcaaagtcgtatgctttatcaacttttttaacatggtcctcgttcatgtacccagcaacgaggtcatgcacttcttgtgcggtcaacacttttgcttctgccatatatttatcctctgtttccaaacaaccgccgatggggattcgaacccgcagcgtgtcattcgtgatatatccatctggatagttattgtttattgtaacgcattcacacccatttttaatagttattcgtattacaagcataagtcatttattcttcctgcagttaatctgagaaaaataaaaagcgagttctcataattcggaactcgcttcattagaaacagtcatttaatccgcctggaaaaccacgttgttggcgcccaaaacttcttgtagcgccttcattgtcgcatccccagccgataaccaattgcgttgacccaatgccaactttttaccatcggcttcgtatactgccaacactggattattaccgtggtgcgacatgacaaccgcattcagtgcatcaagtgcaccagccgcttgagctgcggctgtgatacgcaaataccagcgcccagtacctggctcagttgtcgcaacttgctcggtctgattctcaaaacgcttgataaactggctcgcttcaacaatcgtattcgcgacaatctgaatatcatcacgaccacgttgttgctcgaccttacccgtcactaccaaaaccttttcaggtactaacaatggcgccacgcgttggaagagttgtgggaacagtgtaattgaaatcgaacctgacaagtccatcccatccacaaacgccatttgatcgcccttcttcgtgcgaatctttttaacattctcaacgtaaatcacgaccgtcgcctgattcatgccaactgccaatgacgaaatatcagtgtgactgttgtcaggaatcgccgccaagtatggctcaattgggtgtccactgaggtaaacacccaagtagtcacgctcataccctagcttttcagccggcgtaaagtcttcaatttcacgaacctttggtgttaacgaagcaaacaacgacatcgactcacctgccaatccaattgcatcaatgaatccttgcaatgacgctagaattgatttgcgattgaatccaaattcgtcgagcgcacccgcataaaccagcggctcaagttgttcaaccttacgatacttgctctcaagacggccaatcaagttgcccaaatccttgtaagccccgttttcttggcgctccttcaggattgattcacggaaatcacgacgcatacccgcaattgaagccaaccccatctggagctcgccttgcttgttcattgaataaccttgccacgaatgattgatacttggccccagcaacttaacgccagatgccttcgcttcagcaatatacgcgccaacctttttcttgtcagcaatagcatcattcaaaacagccttgtaaaaagcggctggataatgcgccttgatataagccaactggaaggccagctttgaatacgccaccgcgtgcgaccggttaaaaccgtactgggcaaacgtttcaatataaccaaatacttgttcggcgaccttttcgtcatgaccgtttgctaccgccccagcaataaagtccgtcttcatcgcggcaatcttagcaccgtcctttttcgacatcgcacgacgtagcaaatcggcaccgcctagtgagaatccagcgaattgttgcgccacacgcataacttgctcttgatagacgataacgccataggttggcgctagaatatccgccatactttggtctggtacgtcttgcttctcttgtccatgcttacgagccacgaaatgtggaatgttttgcatgggacctggacggaacagtgcgttcgccgccacgatatcttcaaagctgtctggttgtaactgacgcaagatgttcttcatcccggctgattcaaactggaacacaccattcgtcatgccgtgacggaacaaacgtagtgtcgcatcgtcatttaagttaatgttggcaatgttaaagttggcaccctcttcggtcttttgaatttcacgtaacgcgatatccaaaatgttcaggtttgaaagtgccaagaaatccatcttcaacaagccaagcgcttcaactggtccctttggtaattgcgtcaccaaacgaccatcttcacccagctgcactggcattgtttgcactagcggatcagctgaaaggacgacaccggcagcgtgcagtgatgaattacgtggtaacccttctaatttacgcgctgtttgatacagcaattcaccatcaactggcaaatcaatcaacgcattacggaaaggttgtgatgattcatacgccgcttccagattggcagcatcacgtggcatcgacttcgatagcgcatcaatctgcgttggatttaagccaaacacacgcgccacgtcacggataaccgcgcgttgtgccatcgttgagaacgtgataatttgcgccacacgctcatgaccgtacttctcgtgcaaatatgacaatacttcttcacgacgattgtcaggaatatcaatatcgatatccggcatttgcgcacgttctggattcaagaaacgctcaaacagcaaatcgtacgcaattggatcaacatcggtaatccaaagtgtgtatgccactagcgaaccagcggctgatccacgtcctgggccagtgcggatagcgcttttgtgcgcaaagttcagcacatcccaaacaatcaggaagtaatccgcaaatcccagttcaacaatgacatccaattcgtgtgccaaacgttcttgatacaccgtctcatcaactgacaaaccatgcaaacgattctttaacccagttgtcgccaattcacgcaagtagtcggctgacgtttgaccattcggcgtttcaaatggcggcaacgttacctttgacttcactaattcaaattcactgtgctcagcaatccaatcagtattcgcgaccgcatcccccaaaccacgtgccacaaattcagccgtccactcttcagcagattccaaataagctgtggcaggttcgcgttgtgcctgggcgacattcgcaatgacctcaccttgaccaattttgcgaatcacttgcgccgcaaattgatcttgtgggtcagcatagtcaacttccgtcaacgctagcaaacgggcaccggtgttctctgacaattggcgtaattgcataattaattcatcacgcattcccgtcgacacacccaaaaagacatggtttgcatcagtcactgcactaatactttgcaccatatccattgcgcgttccggttcggctcccaaaataacgggcaactcaccaacacttggcaacacaatatataggccagccaaataagccgtcaacatgtcaaacgtcacagcttcagatgtcgtcttcaacaagctgctgattgccagcaaattgtgataaccggtttgattctcaaccaacaacaccattggataatgctgtgaagtggccaatccttgaattgtaattgtcagaccgagaattggtttgatatcagctgacttggcagcacggtaaaaattatccatgccgtataagacatcgttgtccgtcatcgcaaccgcggtgtacccttttgcttttgcagaggccacgagttgacttggcatcatgggactttgtaacaaactgaatgccgtttttgtttgtagtggtaccatatctgccccttcctgaacgtcatggttcaaattcgttttaacttaatttcattatagcgataacccgaaaaaaagaccacccgcagaacggatggtcttttagagtcgtgtgtacaactattaatcttccgccttggccgcatccttaggagcagcagactttgagatagctgaaaatgcaaccgtaccgattacaccaatcaccatcgcaaacaatgacgtagtagttgcgttgtatgaagttccttcaagggcactaccgatgtaaccgataatttcacccaagatgaacgtccagaagaaagttacgacgtacttcatttttctacctcttagcctctttcggccaaaatgattttacctgaacagtttacgcctattttcgaaaaaagtcacacgttaattgccacgcctgccaaaattagcgacgcgtgtacttcacaatgcgccaatcgtattgattgtcgtcattagctggaccagaagcaatctcctcaccaagccaaatcgtcttatcaacaggtgccatcaaaacgtcacccataaaatcagtgtctaagtacgtcacgtatagaatgtcggctactggcaagtaactatcataaatcgccttaccaccgataaccgcaagcttcatgctgttttcatcagcaatacgctcagcttcatccatgctgtagaccttgtcaaaaccagctggcactgccaaattttcgtcgtgcgtcaacaccatgttaatgcgttctggcaatgcacgtccgccaaagcttagcatggtattacgtcccatcaacgccacttggtgaatcgtttgttccttaaagaacttcatgtcgaccttttgacgccatggaatcgatccattcaatgcaattgtcccattgttagtttgtgcccagatcaaaatcttttcagccattatcgcttacccctctacgcgttctgatagctcttcccagcgcatcatcttatcttcgagcgcttggtttgtttcatctaattgtgcttgcaactcgcttaacttaccaaaatcagcgccattttcgaccatgtcggcatcgatttggctaatcttcccctcaagttcagcaatgtcgtcttcaattgtgtcccattctttttgttcggcccacgtcaacttctttttctttggcgtctcagtaaccggcttcttttcagcagctggcttggcaggctttggcgcatccgttgtcggcgccccaaattctgctaagtaatcactgaacatcccacggtaacgggtaatttgaccggcaccacggaagataatcaattggtcagcaaccttatccaagaagtaacgatcgtgggaaaccgtaataaccgtaccagcgaatgaacgtaagtaatcttccaaaacagtcaacgtgccaatatccaaatcattggttggctcgtccaaaagcaatacgtttggttgttgaatcaacaacttcaataggtacaaacgacgcttctcaccacctgaaagttgacgaatcaacgtaccgtgcatgaagcttgggaacaagaattgctccaagagttcagcagcagatacgacgtttccatcacggtcagtcacttcttcagcaacttcagataggtacgccaacatacgcttgtcctcggggattggttctgtgacttgcgtgtagtaagccatcttaaccgtctcaccgatttcaatcacaccagaatctagttgttgcacccccgcaatcgcattcaacaacgttgactttccagttccgttagggccagtaataccaatgcgttggttggcttgaattaattcattgaaatcatccaaaatcacacgaccatcaaaggccaagctagcatgttcaatgttgataaccttcttacccaagcgttgttgacccatgttaacttcaacatcaccttcaacttgacgggtaccttgttgcgcttccaagtcagcgaaggcgttttcacgggccttttgctttgtagaacgggccttagcacccgtacgcatccaagccaattccttcttgtagagttgggcagatttgtgttcagcaaccgcttcagcctcaacacgttcggcctttgacgtcacatacttctcgtagttaccgatgtattcgtacaacttaccaaatgacatttcaaaaatgcggttcgtgacgatatccaagaagtaacgatcgtgggtaaccgtcatcacggcacccttgtaatcagacaagtacttttccaaccactcaattgaatcaaagtccaagtggttagttggctcgtccaaaagcaacaagtcaggtgcttgaatcaacacttgcgccaatccaacacgcttacgttgtccaccagacaaagctgacactggcaaatctaaattaggcaagtgcaattgcgtcaaaatcgtcttcacttcagactccgctacccaagcatcttcttgcgtcatttgttgctccaacttcgtgtagcggttcaacaacttttcatcagttgggttagctgaataagcttccaaagctgcttcgtaatcacgaatcaattggaacactggttgggcacctgcgaaaatggcttccatcaccttcttatcgccatctagtggtggctcttgttgcaaataaccaatcgtgtagtcatttggtgtgtcgattgacccactatcagcggggttcaaaccagaaatggcattcaacaaagtcgtcttaccagttccatttacaccaacaatcccgacacggtcgcccgtttcaatcaggaaagacacttggtcaagcagtgttttttcaccataaacactcttcaaatcagtcgcgcgtagttgcttcattacttattcgtctctttctctaccatcttttgtgcttcagcttgcaaaacagcgtggttgttcgccaaatcacctgcaacgaccttacgttcaagggttgccaaaatcttaccaaacaatggtcctggcttgaggcccatgcccttagtcaaatcaccgccgttaaaggccaattcgttctttgtcttaatcttcaagtcagcatagcgactttccagctttggtacatctaccacaagctcactcaacgtcgcaacacgaagcgcattatcaatagctgcaccagtttcgtacaagtcccaggcttcaacgtcgcccaagcgcaacttgttcaacaacttaatagatgccttgattgtcttcaccatatcgtttgagtgcttccacttcttcaagaacaaacctgcatcttcaggcgtcaaaccaagttcgaagaccaacagtgtccaagcttcttcatcgtttgttggttgctggtcagccaacaagtcagcataaccaatcaaatcaatgtcgactgtttccagaccaggcatgtacttgttcaacgtcgtggcaatcatttctagcaagccataacgtgctgccttaccttgaaggagcttcgtgaattcgacattcgtacgctcaatcgcaatgttggccaacaagtgtgcattatccttaatggcttggagcgtcttttcttcaatcttgaagtccaattgtgctgcaaaacgaacggcacgcatcatgcgcaatgcatcttcgtggaaacgttcttctgcttcgccaacggcacgcaagatgtgattgtccatgtctgacaaaccatcaaacatatcaatgatttcgccatccttcgtcagcgcaaaggcattcactgtgaaatcacggcgcttcaagtcttcttctaatgaacggacaaatgtaacttcatcaggacgacggaaatccgtgtacgttgattccgttcggaacgtcgtcgtctcataaccttggccatgatccaaaatcataaccgtgccgtgttcgataccagtatcaaccgtgcgatcaaacaaagcctttacttcttcaggataggcagaagtcgcaatatcaacgtcgtggattggcttgcccaacaaagtgtcgcgcactgatccaccaacgaagtacgcttcataaccggctgcttcgattgtttcaagaattggtagcgccgccacgaattcggcgggcatcttttctaacttcatttcaaaggtcctccttggacttactcgtcctttaagtataccaggaaatgaccgctcgtacggcatttaatcaaagcaattcacactttaaaagaatgaatattcatttatgaacgccatggtgattttcctgctaaaacactaagcttgggcgtccggtacagcacaccagagagcaagtacgtgaggccgaagacaactagtaaactaactggcaccattgccaacaacaaccctgaatccactgaaatccgtgacaataacgcacttagcgcagtcaaaatgaccgtttgactcagatacatcccaaacgaaatctttgaaccaaacgccacggcacttaccacccactttggtaacgtattggtttcgcgcgcttgtgtatatctcatgccgattgtcatagcccacgcaatgacaactaccgcatagaataagacaaatggttgatgcacgttttgtgcttgatcaatcgtacggtctagtatgctacggttaataccaaacacagcaatcgttaagacacctaacacccccacagccacggtcagttggcgtcggtacagcatcaatttcggcatcacttgatgatagtgaatggccacgtaaccccctaatacaaaatagaattggtacgtcaaaaaattgtacccatactccctgaaccaccacaaccaatgcgacgtatctacgtttggaataacgtatttgatgacggttaacgtaattagctgcactgccagcgataccgcgactaatcgctcgtgtttaaatcgcttgaacagccatcgcaatgctgggaaaaccaaatagaactgtaaagtcacaatcacgtagtacatgtagaaatcatccccgtacaaccaattcttcgtgagtgtctgccagaattcggcagccgtcgcattttggatagctgcttgaatgctggtatagattagaatccaaagcaaatatgcccagataatcccaaagaaccgtttccgccagaaacgccaaatctccagtttctttgcgtaatagttcaaaaagatgaccagtccagaaacaaacataaagcccaatcggctaaaatgcagcgtcatgtgcgttgcaaacaaatactgcgaagcgaatgtgtcgttcgggattgcttcattaatcttcgttgtcacgtgcgtcgcaatcacactgaagataaacaatacccgcaacaaatcgacctcatatagatattttctcggtttctcagcattttcacttggcataggagcctcctcaatatcactttgcccgctatgataatgaacgcgacttaaaccagacttgaacataacaaaacaccgttgcaaccgagctcacagactcgattacaacggtgttttttgtttcttattgcacagtcactgacttagccaagttacgtggacgatccacgtctaggccgcgacccaatgatgtgtagtaagccaacaattgcgttggcacaactgatagcaatggtgacaataattcgttgacgtttggcaagatgaagtcatcaccttccttagccaattcttcagtcacgattgtgtaggcgcgtgaaccacgggcttgtgtttcagccaagtttccacgaaccaaaccagctgtctttgattgcgtaatcaatgcaataactggcgtaccttcttcgatcaaagccaacgtaccgtgcttcaactcaccagcggcgaatccttcagcttgtacgtatgagatttccttcaacttcaaagcagcttccaatgaaactgttgaatcaaccccacgaccgataaagaatgcgttgcgtgactcaaccagcatctcgttggctacgcgttgcaatgtttccttgtcatcgacgattccttggataccaacggcaatctttgacaagtcttgctccaagttgaagccaagcgcatcacggtcagcgactgcgtatgccaagatagcttgcaaaccaacttgcgcaacgtatgccttcgttgaggcaacggcaatttcaggaccggccaacaatggcaaagcatacgttgcttcacgccacaacgttgacttttcaacgttcgtcaacgtcaatgacttgaagccttgggcgttaacgttttgcaaaacttcacgtgagtcagcagtctcacctgattgcgtcaagaagataaagaatggcttctctgacaacaatggttgctcatatgcaaattcagatgacaagtgaacttctgttggaatccctgcccattgttcgaacaagcgctttccaaccaaaccagcgtggtatgacgtaccagcagcaacgatgtacaaacgatcagccgctttgatgtcatccaagatggcttgcccaacgtgaacaccaccctcgctatccaagtacttttcaatcaagtggcggataacgattggttgctcgtcgatttccttcaacatgtagaatgggtaagttcccttatccgtttctgacgcatcaatgtccaagtggaatggctcacgtgacgtttcaacaccatcagcaccgaacaagcgaacgttatcaggatcgatgatagcaatttcaccatcgtgcaattcgataaagtcgtgcgtttggtccaacatggcaaccgcgtctgacgttacaacattaaagtcttcaccaaccccaattagcaaaggtgacttttgctttgcaacatacatacgctctggctcattacgatccatcaacaagaagccgtaagctgagttaacatccaacaagctgatcaacttcttcaacgcatcaaaagtcgtcatactttcatcaacaaacttaccaatcaattgtacggccacttcagtatcagtatctgagtggaacgtaacatctggcaagtactcttgcttcaactcaaggtagttttcgataaccccgttgtgcaccaagtagaaacgtccgtctgcagacaagtgtgggtgtgcgttgttaattgatggcacaccgtgagttgcccaacgagtgtgcgcgataccactcgtacccgtcacgttcttcgtatcaaccaaggcttcaagttgcgcaacacgccccttttccttaaccaattggtcagtccccaaagcttggtcagccacgaagataccagctgaatcgtaaccacggtattcaagcttttccaatcccttcaacaagattggtgctgattggtaattcaaaccagtaaatccaacaattccgcagaacataaatatttccccctaatgcacttttataaaccaagtggtataccacctagagttttcattgcgttttaatacaaagactattattgcacaaataaaagcacggtcaaccaaaaatcggactattgtgaattaattggtataaattggtataggtggaactatacaaaatttagtgaaccgtaaaacgttttaaaattcgcacaatttcctacacgcacagaaaaacgccgagtcactttcgtgattcggcgtttcaagtttagcggcttaacgcttcttagacttctttgcggggcgatagtccggatccagcttctgatactcacggacggcgcgatcaattttcttattcaatatattcattccaaacatactgtaacccccttttgttctttgtcattgtaaaggaaacctttacaaatctgtaatattaatttactcctaatatcgaacaatgtcaacagtcattagcgtgttgtttggatttgcgtcacaattgtttcaccatgttgccacaaatcgacgccgattgcctcagccttttcgttcacacgcaatggcgttactacggcaaccactttcgcaatcacccacgtcatgacaaccgataagatgattgtcagcacaatcgctgctacctgaatgccgaacaaatgccagccaccagctaacaaaccgttttgacctgacaatgccttggttgcaaaaatacctgtaaacaagccaccagcaacaccaccaacaccgtgcaatccaaaggcatctagtgtgtcatcataccccattcggtacttgataaccgttgttgccacgtaaacaatcaaagccacaatcccgcctgtgatagctgcgccaacgggttcaatgaatcctgcgcccggcgtaattgcgaccaaacctgcgataccgccagatacagcacccgataccttaacctgcttaaataccagcaaatcgaacattacccatgttagcatcgctgtcgctgccgcaatacttgtgttcaagaacgccaagattgcgacgccgttggctgctagcgctgaaccagagttaaacccaaaccagccgaaccacaacaaaccaccaccaataacaattgatagcatgttgtgtgccgttagctgggtaacatgctgacgcttaccaatcaacaacgctaacaccaatcctgaaacacctgatgaaatgtggacgacatcaccaccagcaaagtcaattgcacccatttgagctagcaatccgccaccccaaaccatgtgcgccaacggtacgtaaaccaacatcatccaaccaatcaggaacaacacgaacgctttaaagttcatgcgacccacaaccgctccagcaatgattgccatcgtgatcatcggaaacatcccctggaacaaagcaaacgcaccatccggaattgataacccacgcgtgctttgcgtcattgaaacaccattcaaaaaggcatgcttcaaatcaccaataattggtccgttaccgctaaacgtcaatgaatagccgactgtaaaccacaacacacccccaatggcgatggcaattaaaaccatggccagcgtgttaacggttgatctaacgtctgaaaacccgccataaaacaatgccagacctggcaccattagccaaactaacgctgaactcattaatacccatgctatatccgatccgctcatgtcgtcaccctccgtctttctaatcgttccttaactttacgattagtataggcgtgattttcgttatcggagcaaaccttgttaggaatgcttacatattgtggtataggccaaaaaatggtcgcaccacagctggtacgaccatttaaaaatttatattaaacttcttggttgagttccatcaacaagtggtagatggcaccaaacaaattagcatcgttagcaaattgaccggccacaatttcaaccggcgtcaaggttccagccacaacttcatttccttcgaagaaagtcatatattgatcacgaatgcgttccgctacaatcggctgagcagaaataccaccaccaataacaatgcgttggacatcaacaattgcttggatattttgaatcagcaaggcaatttcagccgcataggcatcaaaaatatcaactgcgactggattaccagcattaatgtattcaaatactgctagtccatcatcaatctctggcaacttaagctcggtcccgatacgtttaatcatttcgaccgccgatccgttcaatccaatcgacgtgtccatccccttttcaagttgattgaaaatgaaactcaattcaccagcttgaaagtgggtgccataaactaaattaccatttaggactaacccgccaccaacaccagtccccaaaacaatggccataccatcttgtacatcctttagttgccctaaccacaattcagctaaggccgccgcttttccatcattttcgacggcaattggaatatccaaagctaacttgtcacgcaagttaacgccatccataaacgttaatgaaccgccacccttaattgtgtcatcaaggtgcgctaacttccccggcaggctgaatccaacacctcgaattttgccatcataacgtccgataacatctcgcaattgtcccaaaaatgcctctaaaccagccgtgttagtacgctcactaaacttttcgatgatgttaccagaccgatcaatcagaccaacttttaaacgcgttccaccaacatcaattgctaaataatcttttgtcatgctattaactctccctactttactggtacgttcacctgttcatcaaccctagctggtcgttttaccccagtaacgaccagtgtaatcacggctagtgccaaaacgataacagcatcaactgtcatactgaaggcagcggttgacctaccagacaatgttgaaaccagttggaacacatacgggcttaagaagacacccatgttaacagcaactaataaaacagttgaacccaatgtttgcgacgcttcatcagtacgagccgctacagctgagtacacacctggcactgccattccaaaggccaacccgtacaaagaaatcaacacacctgaccaaatcaaattttgactcatgctcaagagcaataccataacaccaccggctaatgtccccagaccaactgtgtaccgaccaaaccattgcttaatctttccaaaaatcaaaccagcaacaaatcctgtcgctgcgctgatacctgaaatcagactagcttgtgcgccagtaccataaccaagttgttcaaatagtggtgcaatcttgaccgtcataccaaagtacgttacaaatagaacaaacatgaaggccccatagcctaccatagtccgattaatgtgcgccttgcctacaacttccccttgtttactatcaccacttacggttggtgtcttatcagaaacaaacaaaccaaacataattagtggaataaatccaagcgcgtacacgccaaatgtcatgtgccagccaaatgacattaagtaccccaccaaccaagttagatcagtcgttgcggccgcggccgttgcattttcgaacccgattaacgtgtcacgttctttgccctcgtaataaatcgaaatcaatgagattgccaatgaattaaacaaccccacaccggcaccaaacatgaaacgcgataccaatagcactgtgtaattttcagaaaacattggcacaattccggaaattactgcaatcagaacacccagaacaaccgtcttcttattaccgataatacgcgttacaaagtttgacagcaaaacaaacaacataatcccgaaactagtgactgacatcaacagctcgattgatgattgtgactgcgttggcaagtctttcataatcatgggcacggtcacttgtacagcggccgccgcattggttaatgttgcaattgataaaagcgaggccttaaaaagccatccatgcttgttcataacaatataatcccccttagccatttaaaatgacttactatatctcaacgaagataatattactatgtaagcgcttacttagtcctgtggtttttgcgacaaattaggttgttttttgcttttttaaagctgtagccgtcaatccaaaattcttttttaggctacggtttaatgcctgcgttgaagaaaagccaaccatcgtagcggtatatgcaacacttttttggtcaacagccaacagttggtatgcgtgcattgatctaatcttgccaacatattgcatgacagaataacccgtttgctccttaaagaaacgatcgaaatatgctgcactcaaatgaacgcgattcgctaaaccgaccaaagtgagttcctccttgtaatttttttggacatacgcaatcgtttccgccaaattattggtcatctttgaatcatttttgataccaaaattgctacctagcaaggccaaaagttgcactgtcaacccaataaattcatcatcacgatactcatgatcggccttcgtcacttcaaatatactaatcatcaagtccgccatccttgccactgcacgttgttggtcagatgacataaatattgatggtttcaagataaaacgagtatctgataagcgaggtataaatttttgaataaaacgttgcgacaccaacaatagcagatttcgtcgctctcgacttacattatgaaccccgtgtacttgaaatggatttacaacaataaattcacctccatgcacgtactcagtctcgccgtcaataatatattccttaacttcacctgtcatcgtgtagttaatttcaatttcttcatgccaatgttctggaatttcaatatcttcagaaaacactgaacgatccacatactcaaatcgtaccgtattgtcagcccattcaactttaacatcctcgtatttgtacatcactaatcccctttattccggttccccttactaaaatcactatatcaaaataagtaagcgattataaatcatctctgacattgttaagaaaacaatatttcataattttaatatctaacgaaaaatccgttaccgcatttgaagtcgctacatgataggttagttgtatatttattacgtcatttatcacaggaggtttgatcgcatgaaacccaaatggactattgtatctgttattgtattgacacttgctacggcaggttcaatttggggcattaaaatttactacgatgagcaagcttacaacaagcaaatgagcatcgcccgcaatgcagttgctggccatgaatgggaaattgctcgcaccgcatatcaaaaatctcgcaaaattcacgtatcagttgaaaaccgtaccgcaagtcaacagctaacctaccttgagaatgctgataatgaaattaaacagcataactgggaatctgctgtgaacatgtataatcaagcactaactgttgatggtggtgttgaattgcttaataaggctgctaccacaggtaaaacatacgttgacgctctccgtaattctggtgaggcccaacaaaaagttcaacagttaactgatcaggtcatacaaaagagctctgaaatcgttgccctgcaaagcagtgctagtgatgccttaaaggcgatgcaggattctgccaacaatgcgctttcgtcagctaaaaaggcccaatcaaagcaaaataagtctgatgataggcaaaagcaaaaatcagatactaattcttcaaaggtcgaagaatcaaagaaataacagctatacacaaagcgccgtaacatcaatcaatgctgatgttacggcgctttattagtgattgttgtgtaccgtttccaccttcaaaatgtggaagatgctttaggccattgcgttatctaagcaggtcgctttgcgattcatactttggagttgtacttcgtttgaaaacacaacaaaaccccgtaggctagatttgctccaacacacggggtttagttcacattatgaatctcaatctttttaaattgaatattaacaacctaattagatagtcaacaattccttttccttttcagcagcgatgctgtcgatgttcttcaccgcagcgtcagttgccttttggatgtcatcttcaagcttacgagcttcgtcttctgacatgtcaccgttcttcaatgccttcttggcatcgtccatggcgtcacgacgaacgttacgaactgcaaccttagccttttcagactcacccttaacttccttagccaatgacttacgagtttcctcagtcaaggcaggaattaccaaacggataacagatccgtcgttggcaggcgtcaacccaaggtcagaagcaaagatagcttgctcaatgtccttcaagattgacttgtcaaatggtgtaatcaacaaaacgcgggcttcaggcaccgtaattgatgccaattggttcaatggtgtttcagcaccatagtactcagccgtaacgttacgcaagattgatgggtttgcaacacccgcacggatgttacctagctcacgacgcaaaacgtcggcagccttgcccatacgctcatttgctgaatcaagaattgggtttgccatgttactttacctccacggtcgttccgatattctcgcccaatacaacacgcttgatgtttccagccgtgttcatgttaaagattaccaaattgatgtcgttatccatagacaacgttgaggccgttgagtccatgaccttaagttccttctcaatgatgtccttgtgagtcaaagtctcatacatcgttgcatcaggattcttacgtgggtcatcgctgtacacaccgtcaacaccgttcttagccatcaagatagcttcggcattgatttcagcggcacgcaaagcagccgttgtatcagttgagaagtatggtgaaccagttccggcaccaaaaatcacaacgcgtcccttttccaagtgacgaacagccttacgacgtacgtaaggttcagccacttggcgcatctcgatagcagtttgtacacgtgtaggaacgttgtgtgactccaaagcatcttgcaatgccaaggcattcatcgtcgttcccaacataccaacgtaatcagcttgggcacgttccatgcctagcttagcgccagcttctccacgccacaagttaccaccgccgacaacgatagcaatttcaacgccaaggtcgtatacgtccttaatttctgccgcaatactgttgacagtttcaggatcgattccatagccgcgttcaccagccaaagcctcacctgacaacttcaaaagtacgcgcttgtactttacgtctgccattttatagtagcctcagttccggattaaccgatttgtgcggcaacttcagcagcaaagtcaacgttagccttttccataccttcaccaacttcgtagcgaacgaatgaaacaaccttgccaccctttgactcaacaaacttagcaacagtttccttaccgtcacccttaacgaatggttggtcaaccaatgagatgtcagccaaaaacttgttcaaacgaccttcaaccatcttttccttgatgttgtcaggctttccttgcaagtcttctgagttcatttgaacttccttctcgtgtgccaagacatcggcaggaacttcttcacgtgaaacgtattgtggtgcaatagctgcaacgtgcatagcgatgtcctttgcagtctcttcgtcagcaccgtccaacaatactacagatgagatacgtccacccatgtgtgagtaagttccgaactcttgtccttcacccttttcaacgatttggaagcgacgcaaagtgatcttctcaccagtaacttgcgtcgtgcggatgatcatttcgttcaacgtagcgtcttcagaaacttgcaaagccaaagcagcttctacgtcagctggcttgaattcaacgattgcgtttgcaacagcgtgcaacaagtcgttaaactcagcgttaccagcaacgaagtcagtttgtgagttcaattcgatgattgcagcagcgttgtccttaacggcaacgtaagtcataccttcggcagcaacagcatcagccttcttagcagccttagccattcccttttcgcgcaatacgtcgattgccttgtccatgtcaccgtcagtctcaaccaacgccttcttggcgtccatcattccgacaccagtcttttcacgcaattccttaacttgtgaagcagtaatagccattgttatggtctccttgtaaatgctaaatctttatctataaaagtatacatgatttcttaggttatatctagtataccgacatagaactttcaaaattaaaaatgcttagacacatcttctacttacaatacgaaaaaagagctacatctgcaagcagacataactccattagtacttaatattagtggatgaacaatacaccggctggtgaaatcgtacgtgatgacacaacgtattcaccttgtgcgttcatttctgaaatcgttaccatgccaccgttaacacccgtcacaacggcaacgtgaccgtatgatgaggcaccggctacacccggcatgaagacagcaactgatccaacagttgggtttgaatcaaccaagcgacctgcagtggctgcactggctgcccattggttagcgtttccccagaagttaccaacccatgacaacgtgttctttacgtaccacgtgcattgaccagcgtagtatgagttaccaggtacggccgtcatgtcagtgttgtagtttggtgtttgggcaacaggctcatcagccactggtgcttcggcaaccggtgcttcaacgacaggagcttctacaactggtgcttcttcaactactggagcttgttctacaacaggcgcttcaactggtgctacctcagcagctggtgcagcttcttcagcaacaactggtgcttctgaagcaactgctgcatcagcagtcaacttgatctcttgaccaaccaaaatgaagtgcacgtctgagatgccgttagcggcagcgatttcgtcagtcgtcaattgagtagctgatgcgatcgttgacaatgtgtcaccagcttgcacaacgtaagtttcacccgcagcttgcacagcagtttgcacgtcttcaactgtcttagcacgccatgatgacgttggttgtgctgactcatcagctgatactgacgtcgtcattgccattggtaccattgcaactgcaacagttgccaccattgcggctacccagttcttacctgctttgtacatcttcttgtgtgaattagcgttttgcatgattaactcctcttaatgtcgctcgtgtaaagcgtctcttcttagtctctgtatttgtgtgttgctttttgtgattaacttaacaacaggtataagattacagacgtttcatgacagcgtaataacaacaccgcgacaacttgtgattcacacaatattcacaattccaaaaccactaaacaagcatccccattggctttccaaacacgacctttacatttttcttcacaatttccaaaattcgattacattgcattctccacttttatgcacaaaaagtgcgttaaatgacagctatgtaacacgatttcagaaaaaaagagcgattgcttgtcgcaatcgctccctattttgatttgttttagttaaaactacccgtcatttggtccatgtgcgtcacttgtccagtggttgcatcatagcggaacaatccagccatgttcgttactgatggatcatttggattatctacacgagcttcgacttggtaaactgagccagtgttagccgtaataaagtacgtcacgtctgaacttaggccaccgttagcacgttcgtaggcaatcactgcattaatcgcatcttgtgaagcattcgcagttgatggtgcagtttgcgcagcaactgctggttgagatgaagaactctcagcagccaccgtctctgaagtgtcattcttcactgaaggtgttgatgccgcttcagttgaaaccgatgaactgactgatgattgtgagctcactgcagatgtcgagattgagcttttcttgctacttgcagatgaactagacttgcttgactttgattgactcatttcttcttgtgttgcatgacgtccgtcggcaactgtactccaggccattgctcctccgaagcctagcagaaacaccaacgccaccacgccaattacttttacacccttcattacgctatcccctttcagcgacttttttgataacgtaatcataacacaggttacaagaatgtaacaggaatatttaagtacgtttccatgaagaaattgtcacgcttaaatcgggcttaccaccaaccatttgcttggcggaacttaatcgcgttatcgattgaaccgtaacgcgtcaccgcgtaattaatcatccccgcagtttgttgggcaacggttccagttccccatgattgtttggtttgtcctaggccacgatacccatttggtgaaaccgcatttggattaccacctgattcaggcatgacaatgtactgccacattgcatcggtaccacccgccgcaataaactgatcatagactgaaccttgattggcactacttgcctttttcgtaccaacacctgaaccatcaaaataccaatcaacaccgttaatattaattgtcgtattcgtcaccttcaaataagtacttggatcaaagtagtagtagttaccggcccatgattgcaaaccgctttggacagtaccatcattaccaactaggtaccagctaccccaacgtgcttgaatgtaattgcgcttcgttgaaagagccttcgtacttggatcaaagtaatagtaggtattaccaatctttgtcacatcagaggcgaatgaaccgtccgccgttgcgtagtacttggcaccaccaattgttagccactgtgacttacgcaatgtgtacgttccgtcatcaccaaagtagtacttgttaccattaatcgtttgcaaccccgtcactgctcgaccatcaccgccaaagtagtacgtattgccccactcatcacggaacgcattgtcggtacgcaaatgggtggtcttatcaaagtagtaataaccacccatgtattgttggatttcgctcaacttttgtccatttttaaataggtaccagttttgtccatcattaatataaccgttcgccaaactaccatttgtgtagtaaagcccatttgaatagccatttgccacattggcagaaacttgcgcattaggcatgaaatcactttggatgatgaccgtcgtcgcaccaaatgatgccaacgctaatgccgttaaaattgctgtcttgctcatttttttcattttaattcaccttattatagaaacaaaaggggctgttgccgtaacagtccccctttacccacaaaaactacttagcttcaccaacaaatgtttggctggctacatcataaccgaaaccaacacgcgtaatagagctgtttagaatccaattatggtgaccaggtgcaccatacatattcgtttcattaaaccaagcttccatagccgttgcccctgaaccaaattgaattgctacaacttctttaccatacgtttgattgtaatgggcttgatcaacagttcccgccatttgttgcgcacgagattgcgctgttctagccaaaccagcatcgtaagttactggttgcaagccggctgcttgacggtattggttcatgcgattcaaagcagctgagaattgaccggcatcagcagatgaagacttcttagtaccaacacctgagccatcaaagtaccaatcagtgccattgatgttaaccgtcttgtttgtcaccttaagatacgtgcttggatcaaagtagtaatagttaccagcccatgattgcaaaccactttggacagtaccatcactaccaactagataccagctaccccaacgcgcttgaatgtagtcacgcttcgttgaaagtgccttcgtacttgggttgaagtagtaataagtgttgccaatcttcgtaacatctgatgcgaatgaaccatcggccgtggcgtagtacttagcgccacctagcgtcaaccattgtgacttacgcaaagtgtacgtaccgtcatcaccaaagtagtactagttaccgttaattgtttgcaacccggtcactgctcgaccatcaccaccgaagtagtacgtattaccccactcatcgcggaacgcattgtcagtacgcaagtgtgtcgtcttatcaaagtagtagtagccgcccatgtattgttgaatttcactcaacttttgaccgttcttgaacaagtaccagtgttggccgtcattaatgtaaccattcgctaagctaccgttcgtgtaataaagaccgtttgaatagccgttcattgtgctagctgaaacttcagtcccaggtaatccaaaacttgttcctagcgtcgtgatagttccgaaggccagcaatgcgactccgctgaccagaacttgtttcccaaaattcccataaatagacattgaaatatcctcctataatacatccctaacaacacaatcagcatatctcattcgatttatataactaaatcagatattatccaattggtaaaaatgtatataaagcaggctgagaatgtcggaggtttttgacctgcaacgtaataaaagaatacaaaaaagcacccgctaaaaattaatttagcgggtgctttttaaccgattaaaatcgaattagttgttaccttcaacgatttcagtcaattcttcgattgaagctgccttgtcagcaccttcagctgcgaagtcatctgcagaaactgcgtcttcaccttggttaccctcgatgatagcgtcagccatcttagcagtgatcaagcgaacggcacggatagcgtcgtcgtttgatgggatcttcacatcgatttggtcagggtcggcgttcgtgtcaaccatagccacgataggaatgttcaacttgtgtgcttcttgcacagccaattgctccttgtgaggatcaacgatgaacaacaagtcaggaatcttaggcatatctgcgataccacccaagaacttctccaacttctcgcgttgcttgttcaacaaagcaacttccttctttggcaaacgatcgaaagttccatcttctgccattgcgcgcaattccttcaagcgtgcaacacgcttttggatcgttgaccagttagtcaacgttccacccaaccaacggtggtttacgaagtacatgtttgcacgagttgcttcttcagcaattgcatcttgagcttgcttcttagtaccaacgaacaaaaccgtagcaccgttagcagctgcgtcgcgaacgtagttgtaagcttggtcaaccaacttcaccgtcttttgcaagtcgatgatgtagattccgttacgctccgtaaagatgtattctgacatctttgggttccaacgacgagtttggtgtccgaagtgaacaccagcttcaagcaattgcttcattgagataactgccatgagtatctgcctccaaatgtttttccacctagcctcgcatgtaattccgcgaccctttgcgggcacaccgtagaactattgagaactagtgagtaattttttatggtctaagaccaagaacaaatgatacatgattttgggtaagtagtcaactgctaatcccgttttgctggctcgaaatccgtcacaccacgttcttttaaaaacgccaccttatcaatacgcttcaacttcttaaaagctgcttcagctttcagtgcgtctgacttattatcaaatgcctcggcgtacaacaacttcaaggggtggcgactagccggccgcgtgtacttggcccccttacccgcctcatgtgttgcgaagcgcttaccaacatcatccgtaaagccaccataaaaggtgttgtcagcggtcaacaacacatacatatagtacggtttagtcattactcttgccttcgtatatatcccaaacagccttcgtgtacgtatcatcatcattgtgcgtcacaattggtggcaaaatggttgcacctgttagtgcgccgtctttaatcgcatcaatcaacaagacgttggctggttcaccagcttttggatacacaaattgaatgcgcttaggtgccaaatgattcttctgcaatgactcaagaatttcaaacaagcgatctggtcggtgcaccatgaaaaagtgcgccttgttcttcagcaacttcttggccgtatacgtcacaaggtccaaatcggccttaatttcgtgacgcgcaatcgcatagtgctcatcttcgtgcatcaccgtattttcattgtcgaccgtaaagtatggtggattcgaaacaaccatatctgctgaacctgggcgaatatcgtcgaagatatcacgcatatctttgttgatgattgtaatcttgtccgtcaaatcattcatttgaactgagcgtgtcgccatatcagccaagcgttcttgaatttcaaccccaacgatttgaccggccaccttgtgagccataaacaatgacactgcaccgttaccagcacctaagtcaacattcaagccacgcccatttttacgaggttgggcaaaattcgccaacaaaacggcgtctaatgaaaaggaaaagacttccttgctctgaataatatgtacttcatcgttataaagcatgtcgacccgctcgtcgggtaatagtttcacgtccattgttttctcctgttagtttgccaagattgcctaacctgtgggataataaatcgttattattaggaggattaaccaaatgttctatacatttattcgttatgtcgctgccggagtggtatggctaattaacggccgttacacgttgacaggtcaagacaaactacctcaaggcaattatattttagttggcccacaccgtacttggtgggacccaattttcttcgctcttgctgcttggccacacaagtttagctttatggctaagaaagagctcttcaagaatcctattctacgctggattttggttcacgccaatgctttttccgttgatcgtgaaaatccaggtccatcagcaattaagattccagtgaacaacctaaagaaaactgaacttggtgttatcatgttcccatcaggaagccgtcactcacaagaaatgaagggtggcgcaatgatgatcgctaagttgtcaggcgccccacttgtgccaatggtctaccaaggtcctgttaagtttggcgacttgttcaagcgcaacaacgtgaagatggcgtttggcgatccaatctacgttgacaagaagattaagttgactgatgaaacgatggccgagtttggtgatacattgactgaagctttcgataagattgacaagtcaatcgacccaacttgggtatacatcgaccctaagccaaagacagaacaaattgaatcaaagtaacgtaaaacgccggtcaaccaaatgaccggcgttttaaacataaacagactttttctacttcactgttaccagtgcggtgtacaacatagcatccagattaccacgtcctattagcgcacaacaacgttcatcatctttggtaagttccagccatttgcggactcattcccattgataaacgcccatgttcctttagaaatccagtattctttatttacagtcgaatatggatcagaaatcaagaagctatcttgattcataccaacaatagtcatgacgtggaaagcctggtttaaacgccaagtgtaatcaccccatgtcacaactgcatttcctaagccgatttcacgttcgatatctgcaacagatgcgctgacaaggttttcaatcccaccatagattgacttcgttgcctcagctaacctacgcgcagttactgtttgggtagttcctgtaccgccgccccaagggttgccataaaagtttgaatcaggattaccgtaccatccatagcctgttctattgtaaatatcttgtagcgatgcccaccttccctttacagaaagtgcaatctgcaaagcagtcgcttcacatccttcaggtgcaccttggtttaattgtgagtaccaagtatgtgacaacgtcgtaatatcaaccacgccatcataactatttgtatgaattgaacgtccaggtagattacgccactgattcttcacttgaataccgttgtcatcaaagtattttgttctgccgtcgagtacttgtaaccctgttactgccttaccatcataactgcttaggaagtaccaacgattttgtccagtcgtacgccaatcattttttgcttggataccattgttatcaaaatacttgtaaccaccatcaagttgttggaggccaatcactgctttaccatcgtaactatttaagaaataccaacgattttgcccagtcgtgcgccaagcgttttttgcttggacaccgctgttatcgaaatacttaaacccaccatcaagttgctggaggccaatcactgctttgccgtcgtaactattcaagaaataccaacgattttgtccagtcgtacgccaagtgttttttgcttgaacaccactgttgtcaaaatacttgtaaccaccatcaagatgctgaaggccggttaccgctttgccgtcgtaactattcaggaaataccaatgattttgtccagtcgtacgccaagcattcttcgcttgaacgccgttattatcgaagtacttgtagccaccgtcaagacgttgcaagccaatgaccgctttaccatcataactattcaagaaataccaacggttctgtccagtcgtacgccaagcgtttttcgcttgaacatacgaagcatcaaaatacttgtagccaccatcaagatgttgcaaaccactaagcgcaacaccatccgtgccaaaataataccagtcattttgattcaatcgtgtttgccagccagtttgtttcacaccatcaacaaatctataaaatttattgctaacggtataaaaaccagtggcagctacgttattgatgtagtacttaccatcaacccaaccgttttttactaccgctctagtctctgcttgcaccgaatcggttactttttgctcgttagtatcattctctgttggctttgttgactctatatctggttttacagttactgcttgcaaatctttatcactatcttggctagaattcacggacttatctggctcagaatccgccttcgtctccgtgtcaacagttgtctgttccggttcgctttctgtgtcggatgtttccgatggatttgaaatcgaatcagcacttgtggtcgtatcaggtatctcattctcaaccgatgttgaagttgtgccatcgttttctgggctagcatcactagttacgtcgctattgtccccactcgagatttctttttcctcagaattcaacacttcaggattatcttctgaagctacaccgtttgttgacaacgtaacactattcgacggtttctcctgagaacgttccacttgagttgtgtcgcttaaacaatttgaatcttcggtatccgcatgtgcatccccctgtgaaatcatcatcacagaccccaacatgatgctagctgttacaataaacttaccagctttatacaatttatatttcataacatgtcccctcacattactcttaaacctatataaatatgttaccattttgtaactttgtacatcaattgaaagcccttcatttaggacactccgtagctacgcctaacaatacataaagctttatattcaaaaaaactgactataaagaatttgatacgataccaaaacctttacagtcagttaagccctcaaaaacccgtcaaaaaataagcgggttagttaccaattttcaatacttcgtttcgtttaacgatcgtttaatttgggttgttgatatttccggtgttctatccagataaaccacttcggcacccgttttttcaccaacaaaatcaaatttcccagtccaatcgtcgcccattacaaatacgtctgcctggtaaaggttaacatcctcaaccttttgatcccaacgctcttctggaatcactaaatcaacataacgaattgcttctaacaattgtttacgctgttcgaaagaaaaatatgttttctttcctttttcacgctcgttaaaatcgtctgctgaaagcgcaacgattaaataatcacctagttctttggctctacgcaataaatttatatgcccataatgaagcaaatcaaacgtaccgtacgttattacccttttcatttcaggttcccactttcaaattccgtaactatgtcatcaataatttttgtagaaacatccagttcatcaagcaccatatttgaattctcgatttgttgttcgcgtaatggatcataactatctagtaatgccatgacactttccaacgcctcctgcagcgtacgcgtacggtgaacaccagacatccacaaatcgcctatttttgaaaacgatacatgatcaggcctttccagataaaccaccggtgtttcttgtagttgaacctcatataatgaactaataccatctgttaagacgacatctgccgccgcagaatatggatagttcgattctccaatgacgaatgcagtgtttggcaacgcaagccaatcttgcaaaaattgtttgtatctaccgctgtctattgactcaaagttccccgcagcaataacatctggtaatgacggatgtgggtttagaacaactgatacgttcggatgattccgtgtccaatttaacatatccagatatacccggtcgaaagttcccatattaaaccaatcatccccaattgagtggtgtggcatccaaagaacccgcttctttaaattcgtctccggccaccttggacttgtattccgaatcatttccgctttcatagagcctacaggtttaaaaatatcagacgagacaaacgtcttgtccaattcagtcatcgcttttggactaggcgacatcgctaaatacatacgccatacatgctcaaaaaactccatcgtaaacaatggcatcttagagtttggattttcaataaattcttcaaggacaatataaggtacataaatgacttttgtccaataaaagttttcaatcgaatactcaactggaaaatcttgatcccattctgattgtcgtaagacaaaatccggctgccaattctgaattcgcatgaaattagcttcatcgctatctgccaaatctactgtttgaatattctctgccctcagcctatttgctagttgtgtaaaagcctcttctcgaatttgattgcgaaatagtcttgcaacctgaataacttttacttcaaagcgcttatccgctttcgttgccttaataagtggtaaaactgcctctaatgtctcagcagcatttaatataaacaacaatcgaatgcgtgaatgccttgacttaactacaggtgcctgtattattttttttacgctcttttcagattgctgggcttgttcggataacgagtcagttaaaaagtccagtatctcacccttacccatcggccttagaacgtgttgaataggctcctcagtatcttccaaaacaaaatcgcccaccaatttttggggaaactctgatttttccgtcaatggaaaagatgttgataccgccccagcctcgctcaataacactaatttatcatcttgaatgcgccaataagcctcgttaaaactatgacctcttccaaaagaaatctctccatttacacgaaaagccatcgtgtttgtataaggcgtacggttaacctgtccaaaagaaaaaatattacgtgtcaaatattcaaaataatctatgtccggttgctgcgctcgtccgatacgttgcaatatctgctttaacgtcatagtgattccccctagaaaagaaaaagactaccgaggtagtctttttaacaaattacttctttgaagaagcttgtgattgtgccttcatttgagccatcatttggttcaaacgcttttgtgaaggcttttgacccattgaagccatcattgacttcatcatctcttctgagataggtgggttgttcttcaagtacgtttgcattgagcgacgtgccaagaagaaccctgcaactgcacccaagactgcggcaaggatgacaatcaaaatccaaatactagtgctcatcatattactccattatgttattcgtatattattgtagcgaataaacgcccgtttgactaggttatcctgggtttcttcccaaaatattcactagttgtcacgcaatcccctgtcacgttgaatatccttcactttttcaggtgtgacttcattgccgttttcatcgaaaacttgcaacatttcaacttgtgaacggaaagcagccttgaagttatccaagaactccgtacgcaattctgcacgctctgcaatttcgtcgtcagtcaatccttcaggcgtctttgccttggctgccaattcattaatgcgggtacgaacagccatcatacgttctgtttctgccatggttttcaccacctttatctgcttttcatctattttaacacgaaaacgcaatcattcctgcacccactttatttccacccgaataaaaagtaaaatagatagtaatatattcgaattaggaggtccttcagctcatggccgaaaaagaaagtaatcaaattgcgatcctccgttttgtttacgaaaaacaactcgaaaaagggtatccgccaactgttcgagagattggtgaaggcgttggcctatcgtcatcatcaacggtgcatggtcacttaagtcgtttggaaaagaagggttttattcacaaggaccccgataagccacgcgcaatcgacgtcacaccggaaggcatcaaggcgcttggccttcacgagccaaacaagaccatgatgccaattatggacgaaaacgaacccctaacatctgatgaaccgttaagcaatcacattgttgattacttccctgtaccagatgatttgattcgtttcgaaggtgatctgttcatgattcgtaaccgtggtaacgccatgattaacatcggcattctagatggcgactacatgattgtgcgtcgtcaaaatgacgcggacaacggtgacatcgttgtggcaaagccagataacggtcaaacccaaattaagcgtttcttccgtgaggcatcacaataccgcttacaacccgaaaatgataaccacgaaccagttatcaccactgacattacgattctcggcaaagtcgtcggtttgtatcgcgattcaatttattaaaaaataaggaccatccgttcaaatatgaacagatggtcctatttttgttagtaattcatcaatgccaacaactcgtaaccgtcaagacgatcacgaccgtgcaaagcattaagctcaatcaagaaagccaaaccaacgacttcaccaccaagggcttcaaccaacttaattgtggcttcaatcgtaccaccagtggccaacaagtcgtccgtaatcaacaccttatcaccaggcttgatagcgtccttgtgcatttccaaagttgcttcaccatattctagcttgtagctttggctgataacttcgcgaggcaacttgcctggcttacgggctggaatcaatccgatacccatttggtgggcaaccggtgccccaaccaagaatccgcgtgattctgggccaacgataacgttaacaccacgttccttagcgaattcagtaatttgacgcgttgcttccgcataagcggcaccatctgccaacaaaggcgtaatgtcgcggaacgtaaccccttcttctgggaagttagggattgaggcaacgtaatcatgcaaatccaacatctgcttagctctcctgcttacttaggttcgtgagcaacgattccaattcagaagttgaactgtaaatcaattgctcttcaagttgccgacgagccaggaattgctgataactagcagtttcctctaacgccattggcgctggctcaggtacggcatttaaaacaccatcaactattgtaacaaactttgcgtccaaaaacacctgtaatatcaacgttaacatcgaacgttccatccccaagtgcgccaaaaccgcatcatattgcgttctcagtgcgatatcttggaatgaacgagcaaacttatatacctttgcaaagtctgcttttgaagggattttttgcaaataagctggtgttttggcataaaaaatcggtgccaaacgaccggctggtacaaactttagcaaatcaccaagctgtgacatatcatcaggaatatccacaaaggccattgtgccaacgctagtgcgattgaaggcatcttcccaatacaccgcttcagctggtgccttaatcgttggcgctagctgctcgtagtgtttcttgttaaagaaaatatacgttgctggattagcaaatgtttgcgtcgtcaaacgcgttgtacgccagtccaacaaagatgagcccttcgcttcaatatctgtcagcatcatctgatatgacacatccccacggaaactattctcgctcattgtaccgacgatgcgaattgactcaaaacgaccggctaaatcttcagcaagcgacccacgaccaaacgcaaccactggcaacgttccggcagatgtttctgctgtaaagcgtaagtgcttgccttcactcatcgttttcacgttttggacacccgccaaattaactgcaaacaatggttcagagtttccctcaccaaatggcgctaacacctttagttgttcatagttttgtcggttaaagtccttggctgtcacttcagctgcaatgcgaatttcaggcaaaccagcttcagccaaatgttgattggctgcctcttcacgcaaaacatcccgaactgcttggaggttagccattggaatcgtcatccccgctgcgctggcgtgaccaccaaacgccgtcaacagatcacggtgcccatcaagtgccgcaaacaaatcgaaagcggccactgaacgaccagaacccttcatttggccatctttgtcattcaagacaatcgctggcttgccagttgcttcaactaacttgctggcaacaattcccaaaacaccttcgtgccagccactaccagcaactaccaatactggatcagccgtcagcgtggctgcttgagcaagggcttcttcagagattgacgccaccaagtcttggcgctcgcgattcaacttatcaatttgcttggccaattcactagcttcttcaggatcgtctgacaacaacaaacgcacaccgtctgttgcatcggccatacgtcccaacgcgttcaaacgtggtccaattgtgaaaccgatcgtcattgaatcaatgtcagcttgcgcagtaccggcaacttctaacaaagccgccaaaccagggcgtggatcttcttttaagttccccaagcccatggccacaatcgcacgattctcatcaactagttcaatcacgtcggcaaccgcacccaaggcagctaggtccatcacctcgtcagccggttcttccagcaaagctgacgctaccttgaaagcaacaccggcacctgaaagcccaccaaatgggtattgtccttcagggtgacgtgggtgcacaactgcaactgcatcgggcaattgttctggcaattcgtggtgatccgtcacaatgacatccacaccattggccatcaaccaatttactttttcacgaccagagacaccattgtcgactgtaatcaacaactgcatcccttcgctagccaagcgctgatattgcgccatattaggcccgtagccgtcgttaaaacggttcggcacataataactcacatcggcacccatcaactcaagggcccacgtcatgatggctgtactggtaataccatcgacatcatagtcaccgtacacgacaatcttttcaccgttgtcgatagcggtcatgattcgttcaattgccacatccatatcgtgcaacaaaaatggatcatacagtgcatccatccctggccgcaaaaaggcattggcactttcaatcgtgtcatagccacgattaactaagattttggcgaccaaatctgaaacaccgaatgtctcagcgatttctttggcagccccttcattggctacagctggaaaatcccattgatagcgtggtgaaatcatcgtttggtcctcctattcttctagttcttcatcatcaactggtgttaatttgattggcttgctgttactttgcttcccgaacggaatgtcaaagacatcaaagtcattcacgacacgtgtgttttcaaacgttgtacgcgcttgataggcaagctcattcgctgacttacccgcatagcgcgctgaaatgtgtgtcaacaacaaacgaccagccccagcttccttagccacatcagcagcttgcatactcgttgagtggtagtgattacgagcttgcttaccttcacccttgccgtaagttgattcgtgaaccagcacatcggcatcacgccccaaaacaactgagttaggcgtcttacgtgtgtcgcccaaaatcgtcacggtacggcccttcttagccggcccaataacatcggcacttttaatcgtgcgaccatcaggcaatgtcacatccttaccacgcttcaattcaccgtaaagcggcccagctggcacattcatctcacgtaaacgatcaaccaacaactcaccagcgtggtcatgttccacaacgcggtaaccaaatgacaaaatcttgtggtccaaaggcaaagctgtcactgtaaatttgtccgtgcgtaatacttcgccaccttcgttaggcaattccacaaacttaagtgggtatgtcaggtgcgtttgagccacacgcaaactcgtttcaacgaattgcttgataccatgaggtccgtagattaccagttcatcttcaccgccttggaatgagcgtgatgacaacaatcctggcaatccatagatgtgatcaccgtgtaagtgggtcacaaaaatcttatcaacctttcgtggtcgaattgttgaactcaacatttggatttgcgtgccttcaccggcatcaaacaaccaaacggaattaatttcttcaagcaggcgtagcgcgatactcgtcacattacgaaaacgcgctggaacgccggcaccagttcctaaaaactcgatttgcatggcttcggaactccttatctttcatctctaccaaataaaaaaccgccatactgacggtttaaagctaactattagtttaccatttttagcaagtctttgacagaccgtgcccgttagaatttgacgtccaacgactctgaggctcctgtcaattgttgaccatcttgatacgtcggtgcaaattgcaaggccacatttttcaccgaaaccgccaaagattgaggcactaatagtgcaacaaatgtttctttagtttgcccaggttcaacccctgacacaagtgtgtgatcattatccaagccaccaccctgaacagaaacaacactaccatcgctaaattcagccgaattaacaccgtctgtaataatcgttgctgcagcattattcgttaccgtatagcgtacaatcaaagtggtgtagttacctgtaatattgcgtgtgttaaatgccatttgagccatttgaattgcttcatcagttgctggcgaatttgccatctttcttacagaatctatcttatatgacacttgtccattatcaagttgacccgtcacttttgattgttccgctaactcagctttattaccctgctggttaatcgtgtattccccaactttacttgccgcaccggatgacacgtagttactattcttcaaatctttttcgggaactgaatagcgactactcttttgaaccttaccatcttgcaatggctttgttactgaactttcgtgtgctttgctttgcgttttaccgccgttatcttgtgtcataaagaccgtcgcagcaacaccaccaccgacaaccaacacaccaactaatgatcctaataatgcctttttcataccgattaccctatcttaaaaactcacctttaatggttttgttgccttagtaacttgtaccccgcgtgaatcgaacagcgctgaaaattgtagtgctacttcatcaacatttttaccaatcctcttcggcactaccactgttaccgaaccgttcgcgctatcacctggcacaatccccatactcaacacttggccgttatttaccaagcctgtcaagcgtgacatcgtctcagcgtgattaaacgctgccgtagtcacacctcgcgtcgcaacagttcgaaccgacccattcaccaacgcataagacattgtaactgtgtaatacgtcgctggcaaatcaggtacgttatacaagcgtcgtgcgacacctaatgccttatcgtcgcgcgctttttcgcgtacaaccgctactcccgtcacctgatatgacatatcaccagcctggatatatttattgaccgacttcagcttgattaatttttgctcgataccatcagccgtcaaccgatattgaccaacccgactcaattgaccttcaccaacgaagttagatgattctcgatcgatatcagtggcttgcccgccatttcctgacgaagaaccagccgatttaatcatcgattctgttcgcttggtaacactgttttcagcgattgtgttttttctgcctgggttatgacctgagacataaataaatgtcacaacgctaactaccataagtaccggcaaactaacaatcagccatcttaaacgcttctgcatgtctctctccactttaacctagcaccaactgttcagcaaccacacggtagccaaaaacagggtgcaattgttgtgcatcatcccgcacaaccaggttcaaattattatcttctaaagcaatgacgtccgataatgtgacttgtcggtctacatcggtccccaacactagctggtcattatcagtcccgaccagccgcaatggtacaacatcgtcatcaactcttgctgccaacagccgatcaatcggcataccagccgttgacaatttaaaatccgctagcaacatgtttatcaccttttcctattagcctattttgccataaaaaaagatgacgaaccttaaatggttgccatcttcccttaaaattttaaattatccgaagaagcccttcttgtgctcgccgctcatcgcagcttggaaggcttcaagggccttcttttggtccttgttcaacttcttaggcacatcaacgtaaatcgtcacaatgtgatcaccttggccaccacgcataaatggtgcaccttggccacgaagacggaagtttgcttcagttggcgttccggctggaatcttcaacttcttcaaaccgttaacggtcttaacctcaatttcaccaccgaggacagccgttgcataatcaatcgcaacacgtgagtaaatcgtgccaccatcgcgttcaaagccatcctttgaaggcgcaacacggaagaccacgaacaaatctccgtaagggccaccgttgtaaccagcttcaccttgacctgacaagcgcatttgttgaccgttctcgacaccagctggcaccgtcaccttcaactccttgctctcttgaccaccgttctccgttgaacgagtatatgaaattgtcgtttccttaccaaaaacagcttcctcaaacgtcaagttcatgcgatattgcaaatcttggcccttacgaggacggtttggatcttggaagccaccaccaaacatttggctgaagatgtcaccaaggtctgagaagtcgccgtattgaccgccaccaaagccgccgaaaccaccttgaccgccaaagccgccagcttgaccatcggttgcaccgtattggtcgtacatggcacgcttttgctcatcaccaagcgtctcataggcttcttggatttccttgtacttcgcctcggcaccttcctcgtggttgatgtctgggtgatacttctttgatagcttacggtaagccttcttaatctcatcttgtgaagcgctcttatcaacgcccaaacgctcgtagaactctgtgttgttcatgaggccaatcctcccaattttctcaatatgtatcacaaagcgaggcattgcggcctcgctttgtgtcactcagtaaccataggggtagttaagagtgtgtttttagttactaaattacttcttgtcgtcagaaacgtcttcgaagtcaccgtcaaccgtgttgtcatcgtttgatgaagcaccgtcagcagcttgtgcaccttgctcaggagcagcttgttgatacaacttaactgccaattcttgagcaaccttctccaaagcttccttcttcgtcttcatgtcatccaagttgtcagcttccttagcagccttcaactcagcaactgcgtcttcaactggcttcttgtcagtatcaggcaacttgtcgccaacttcttccaaagtcttttctgattggaagatcaattggtcaacgtcgttgcgcaagtcaacttcttccttacgcttcttgtcggcctcttcgttagccttggcgtcattcatcatacgctcaatttcttcgtctgacaatgaaccagagctttggatggtaatcttttgctccttgttcgttcccaaatccttagcagatacagaaacgataccgttacggtcaatgtcaaacttaacttcgatttgtggtacaccacgtggtgcagctggaatgtcagtcaattggaagcgacccaacgtcttgttgtcggcagccattgaacgctcaccttgcaaaacgtggatgtcaacagctggttggttatcagcagcagttgagaacacttgtgactttgacgtaggaatcgtcgtgttgcggtcgatcaacttcgtgaacacaccacccatcgtttcgatacccaatgacaatggcgtaacgtcaagcaaaacaacgtccttaacgtcaccagtgataacaccaccttgtacggcagcacccaaagcaacggcttcatcagggttgattgagtgatcaggctccttaccagtcaaagccttaacagactcttgcacagcaggaatacgcgttgaaccaccgttcaagataaccttgtcgatgtcgttcattgacaaaccagcatccttcaaagcgttgcgaactggctcttcagcacgctttaccaagtcagccgtcaattggttgaattgggcacgcgtcaaagtcgtttgaatgtgcaaaggcccttcgttcgttgccgtgataaatggcaagtcgatttgtgcttcgttagctgatgacaacgtcttctttgccgtctctgcagcatccttcaaacgttgcaaggccaacttgtcagccttcaaatcaacaccgtgctcgttcttaaagttctcggccaaccagtcgataaccttctcgtcgaagtcgtcaccaccaaggtgcgtgtcaccgttcgttgacaaaacttcaaagacaccgtcacccaactcaaggatagaaacgtcaaacgttccaccacccaagtcgtaaacaagaaccttttcatcgttctccaacttgtccaaaccgtatgccaaagcagcagccgttggctcgttgatgatacgctcaacttccaatccagcaatctttccggcgtccttcgtagcttgacgttgggcatcgttaaagtatgcaggaaccgtgatgacagccttatcaaccgtctcacctaggtagtcttcagcgtacttcttgatgtattgcaagatcattgctgagatttcttgtggtgtgtagtccttgccgtctacagttaccttgtagttggcatcacccatgtgtgacttgattgacaaaatcgtgtcagggttcgtgatggcttggcgctttgccgtgtcaccaacttgcacttcgccgttcttaaatgaaacagctgatggtgtcgtgcgaccaccattagggttagtgataacctttggttgtccaccttccaaaacggcaacagctgagtttgtagttcccaaatcaattccaatgatctttgacataattactttacctcttattgatcagttttttgttttattaaataaatgactagttgtttagttataaacagctaccattgctgggcgaatcacgcggtccgccaagacataacccttttgaagaacctgcgcaatcgtatctgctgggtgatcatcatcagccggtacagattggattgcttggtggaagttagggtcaaacggttcaccttcggcaccaacggccttgatgtcgttatcttccaaagcagatacaagcgtcttgtacaccatctcgactcccgtcttgatttgttgtgccgccgcatcatctgcttcaacttgcaatgcacgttccaaattatcaagcgctggcaaaactgactttgccaagttttggctagcatacttcactgccgttgcttgttcctttgcataacgtgtttgcatgttttgcatttctgcatgagcacgcaagtacttgtcttctgcttcagcgatcttttcttccgcttctgcaatcttcgtttctagcgcaacgattggatctacatccgccgttgcgtcggtgtcaacatccggtgtctcaaccgtttcttctacaacttcttcttcaggagtttgcttatcctctgccatgctaacacctcttttctaacggtaatattctaataactgtgttgataatgtactgcggtaggcatctaccaaattaacaacatccgcgtaacgcattgctgtcggtccaagcactgccagcgcaccgacaccatgttgtggcacgcgatatgtggctgaaatcaaactgtatggtgacaacaagctgttaccgttttcatccccaatttgaatcaacaccccatcgtttgcgttccccattacctggcgcattgcacttggcgcatcaagcaattgcagcaattgcttgatttcttgcaactccgtgtcgtccgtgtagtccaacacatttagtcgaccaccaacaaacaccttatcgcgaattgaacgggccaaaacgtcgccgaacaattgcaagaatgcaactggcgttcgaattgtgcgttccatctttaatggtagatctcctgacaacgttcgcaacacatcaacaatcggttgattaaccaatgtttgattaatgtagcgcaccatgtcatccagaccacgtacatccattccctcgggtagcctaaaactctgacttgtaacctggccgtcgttcgtgacgataatcgccatcacttgttgaccgtcgaccggtactagccggaacccagacaatcgcgtgtcaactgattccggcttcaatgcaaccaccgtgtaacctgttatatttgctaattcagtcaccatcgtctgcatcaagtcgtcaatttgttgaaaattacgattgaaaacacgttcaagggattgctgggcaacctgggtcatacgttcgctacgcataatcttatctacatagtaacgataaccacgttgtgatggcacccgtcccgacgatgtatgttccttttgcaacaaaccttgctcttccaatgaggccatctcattgcgaaccgtggctgagctaacagctaaccctaattcttcaagcaatgtttttgatccaacagctttaccggtttttgcgtaatcttgaattattgcggctagaattaaccgctgccgttctgttaacatacgcttcacctctcttagcactctcaactacttcgtgctaacgattattataatacacgcctcgtagacccttgtcaacaattttagcactctaaattccagagtgctaaaaagcgtcgcaattccttgcgacgcttacgtttctattttttgtatctaaaaatcatttgaacaaaatcaattgttgtcgtaaccatttgtttcaatgcaaatgacaaaacaacatccgcttttctgacgaccggtgtactgaacacaaaaacaacaattatataggcaattaatcctaccgtcgcctccagtgccgagaatttcggatacggccctggcacaacatgaataattgctaaaatgctcaatgcagcaacgccaccagcaataccataacgccaaacaactcgtacaatctgccagatattcagcgcgcgtcgtagcaacaacacttgcaaaactaacgcaatcaactcacttatcaatgccacccatgccgctgccaccatgccatagacaggcactaatagtaacgtcaaaaccacgttaatccctgcaccaacttggacaggtgcagacacgtttcggaatccgcgttcggctgccatttgttgcagtgccaaactatagcgccatgacgcaaccacgatgacaaacgccaaaatgcgtaatgcatccccagcattagcaaaatcaggtcccaaaaaccaataaatcgcttgaggtccaaccgttgcaacaccgaccgccacgataacacctagagcagacccgtactcaatggcatcataaaacgattgttcaacaccagcagagtttcctttttgtctttgttgggttacctgagccatcattgccatcgcaatacctaacaccaaagccaccccgacctttaccaacagctctgcgctatagtacattgcaaccgattcaacaccatttgttacaaaaaggacagctttgttcatatacaatgcgagttgcggcaataatgaaactgctagaaaaaatcccagtgacttcatgtgcactctcaccggcaagattttcatattcacgcgcacaagtacactcggcaagcgaatccaaagcaacaaattagccattatcgttgtaacggccaataaaataataaatcggctcaaatccgtcggatccttcacgaaaacaattaaaggcacaaatcgcaacatctgtaccaacgcatcacgcctaacaacgactttcgttttgttaatgccattaaagagccaagaaatatcaagtatggcaccaatatacaataacaactgcaatctaaaaatattcgtgtaaggcaaatcggttactctgataataccccaaattattgttgccaatacaagtaatccgataacctggattgcccacacacccaaaaaaaacgatgaattgccacgcttatcaggtggcattttgtttagttcgttctttgcgtacatccgaattgcggttgaaaataccgcaatcgttatcataatcaacgcatatgtaccggcttgaactcccaatgcctgcaaccttagaatgtgagcaacatacgttaaaaaaaacagcggcaccagttcacttgtcaaccgcatagccgtttcttgtatgtatacttttaataattgcattactctcacgtccttgttgttcttcattaacttaaataagcctagcaaaaaaggaagattaatatcttcccttgaaaatcacatttaccaatatgagtattacgtgaaaataaaaataaatttactttttatatgttgcaaactcaatttctggtttgaatcgtaaccctgctttcacacctttcaaaacgactttcaagcgtttcttgcgatgatcaacatttggggtcaataacactttactcaaatccaacataattcggacagttgacttaacatgtccaacaaaactacgcttacgcccgtaataaactttattgcggtatgaataatagtatcttggcaagcgccccaaatcatcctttacaacagatgagccaacgttactagccattttgtgaagcactttagcagctggcacaaaataacctggtgccacacgactggcacgctcggtatactcaatatcatcaccccagataaagaaatctgtgattggcaacccaatttcagccacaatttggcgtggcatcaaaagagaaacaaaagtagcgttgagcatttcttctggctcggtagcatcatcggcaatatgtccaatcccgcttttgggcacaggtaaattcatcttagtacgttgaccatcaatccaacgaatatctgaagacaagaaactaaatcgtcctgcctgcgccgcaaaatctactaattttgttaacgtttctggatatggcacagtgtcatcatccatcaaccaaacaaaatcgtcgtccgtcttttccataaagtaacgaacaccccgattaaatccaccggctccgccaagattatcttctaatcgaaggtattcaattgcgtcacccaatgattcaaggtaattttttgtgtcattatcgctatgattatcaacgacgataatatgatctaccttcgtctcagaagcctgcaatgctgcaataacttcctttaacatctgcaatcgattgtacgtcactacaactgcacttgtcgtcataagttcacctacttcttcattaacttcttagagctaccaggcaaaaacttgtcattaagtccctttttaccacgcaagaagtccttcaatgattcataggcaatcaataattcgtacttacgatatcctttaatacgaggactcaataggttaaaccaaacacgtgcaactttaaggatgaaatatggatacttaattggtgcggcggcattcttccagaatgtgtagtacatgttacgtacaccatagtagccacgccaatccggcgtatactttttcaaggaatctaaggccaccaattctgtgtcatgtaaaataacagctcccggtacattgtaaaccttagttactttatgtactcgagttgaataatccaaatcatcccaccaaatgaagtaatcacgttcaggcataccgaccgttttaatcgtcttcattgacaaaaatgaaccaacaaaggtgaaagcatcggctacaaattctgtgtcataagcagtcaatggcacttcttgccacttcaatatcttatcattgatgaattggaaccgatgtgtgatgtctgtacgtccatctggcaccttgacttgactgacaaagccaccagcttcgggatggcgattaactgcttcagccattttttcaaagtaccctggttgatagagaccgtcgtcatcagcaatcgatacccaatccacatccagcttttgtacagcttcaaaagccgcataaaatccacctgacccgccaacattttcaggcagctcaataaattgaatcaaatcgttattgagataaccttcttgctcgagcaatgcttgcgtaccatcagttgaggcattgtcaactagaataacttttgtcggcttaatgctttgtgagagcacggcatctaatgccttaacaagcttctcctttcgattgaatgtcacgattagtgctgcgtactttaacataattgtcgtccttaacttttataatccaagaattagtataccatagaaaaaacgcgactaactgggtagtttagtcgcgttttaatcattgacgtgctccaattcgaattggaaaatcacgatcaacaaagagtttgtttgtaatttttgttgaaaccaataaatacgcaagcgtggtatctattatgaatctaataattgcaaaagcaatcattcctaacaataacgaagatgattggtgcaaatgacttgttaattgtcgcagcacagcactgacaatcataccattgtcaaaagcatgcacaataaaaatcattatcgaaatttgccctagataagctaagaatttggatgttcttcgtaaacgttgactcatactcaacttatttgaaatttgcaacaaaactaatgcacttgcagctgcacctattgtacttagtacaatgttcggtgcgatgccggcactcaataagtacatgccactcttagttccaatagctaccaaaaacagttctagaaccacaaaccaccacactggctgacgaatgaatcgtacatgtttcgacaataaataacccataaaatagtatacctgaacctgcagagcactttggaaagtccaaggccagaaataaattcttgctatcgccattccaagcgcagtcataacaagcacacccacaccacgataaacgtcatttggcaatcgcataatcaactgaaaaataacgtttgcaacaaacatcatcggtaagaaccagaacacacctgcggaatatgcaacatgaatgtttcccggcagagtcacgtttgttgcagcatttccaacagttattgccatcaagtagtccggcacatggttcaactcccgcaaatgtctagccgtatacaatgcgaaaaaaacaactgtgccgataagatacggcacaaatagcgtgttaattccgcgtaacacggtctgcttcatcgtcttatttggtcgataaaaataaccgctcgatacaaagaacactgatagattagccaaaaatactaaatttactaagatcttatattcagatgtcgcaatagaatgtccgagtataacaagcataatggctatcgcttttgcaatatcaaatgttttatcgcgcatcttcagaacgttccttacgtccagactttacaagataaaagagtgttccaactaacgtaacaaccgcaagaatccacaatggatagacccaagttggcgtaccaaaggcgaccgttagtcggcgtgcgttttctggcaacttaactagcaaagttcctcgttctgagcgagtagttgacacacgttttccattaatacgcaccacttcattaccataaatcatcacgggaacatcgacagtattacctgccaaggctttcacgttatagcgcaacatagacggtgttgttttcactggattcaaagtttctttttgcaaaccagcacctgagcgaactaaggcttgatgatcgataataccttgcgtatttcgatagtcgtggtcaacagcattaatcggcgcataatcagccctaccagtataatccgtcttcttctgaagaaaatcatagtacgtgtcattcgtgacaacattataagtaacttggcctttttcatccgtaaccaccgccggatttttgcgtgctgcatcatatgttgaaataacttgaccaccaaaactgattagcaagacaaacataaacaatgcaccaaccgtcatctttcgtacacgactgacttgaaccgttctgtccaagtacattaccagccaaataaaggcaaataaggtcgttaatccatataagcggtaagggaactgaataacattagctagcgtacttggcaagccgtaccaagggaaaatagatgtactaaaaaccattaataggattgaaaagccacccgtcaatctttccttcatgttcaactttttgaaccaaacgaagtacaaagccattgaaatcatgacagtcaacccaagtgacacatccatccagccatcaaatgtaataccattgctgattgaattttcaataaccgacgtcaatgatttcaagaaaatcacatgctccgtcttaatcgtggccataattgatgtttgcttcatctcgtagacaaacggcacaaagaaatacaacgttagcgctaaatatagtccgattgctttaaatgtattgattaccttttgccaatcaaaacggattaccaatgagaaaacagccatcacaaagataacaccaccaactagcaatgttgaaagtaaatgcgcgtatgtaaccagcgccatccccaatcctaacaacacccaacgacgttgattgtcaaagtacaacttgtaggcaccagccaatgccaacggaataaacgcgtatgcaagagcctcacccagcacataaatatttagtgctaaatgtgttcgatacgtaccaaatccccacaaaattgcaaaaacaaccgcaaatgtacggctaattttgattgttcgtgcactgtaataggccacgtatagtgtggcaaaaaccagcaacaattcaccaagatagaaagccgttactggtccaggaaccaagacgtagattccagcccaaagatacatatatgcatagggatagaaaaaattaatggcatttccaattttgttaaatgtctcaaaatttctaaaagcaaacccatgtccatcaacgattgcttgacggaacgtttcaattcgattcaagtgaaaggtcaaatcatttgaattaatacttaatatctgcccttttaccatataaacaccgacagcagctaccgatagaacagcaaataataggaagatgctgatcttcgcgtgccggctaaccatttctgacactttagtcatgataccgtttctccaaaagaatataaaatttaatcacgtattctatttaatcaaaaatatcggaaatgtgccacacgaacttgagataccgtgtcccaaagtgtgcacgccctcctctattagaaggacaatttgaatattaatactaacaagtagattacaaccaaagctccaatcaatatgtaaaacaaatgaatgttgtcatagtgtgtttcgctaataactggcgcctttttgatttcactaaacttatagtaaattgctaatccatccgcttttttcccgttgagagtcactggtgaagcatctaactgtgctgtttgcatttctcctacaaggtaagtgtttgtgggtgttaaatcatttgtattaattatcaatctgtattttcctggtcgataatgatcgttaaaatgcacaacactaggtccaccatgataatggtattcttgcttcgttgtggtattaattaatgtaattgttactttctccaattgtgccggatcaccccatccaaagttaaattctaattcctgacttggcgcttctaaatcaaaacgcgtttcaaatttttggtgtgcccttaactcataatcattttcaccagcatacaaaaaataactagaatttttgacaggggttacgattgtctgcttagtttcaaaatcgtgggccgtttcgtttgcatgataggctaccatccccaccgctactaacgacagcactattctcgtccatacccctggcttatcggttacggtccaccaacgttgctttggcatttctgtgatggctactaccgataacaagataaaaaagggaaatgctggcacagcataacgatcacgtacctcccacaagccaatttgaaatgccataatacccaacacagctagcgaactaaaaacaactaaatctattgcggtatcgtcatttagttttctcaaggctttctggacggcaattaaactaagcgacaaaactaaaacataaaacggttgaaacagattagttgccgttctaatccaatttgaaacctgccaattctttcccgattcaacgtctgtaaactgcaataatccaaaatccatattgggaaaaccaattgaaaacatgaaagccgtctttcgaactaggtgctccgcaacaccaacaatccctaactgactaatacgacttttaaattcatggaaaagttttttactgcgctcatctgacggtaaatccgaaaatttccaggcatcagtgccatctatttctccagaagtattagggttccaagccatattaatgtagcgcattgtgggcgttacctgactggcaaccggatggtactcgaagcggttatgcagtgcatcagacccaaaactacccgctgtgtaaaaagtgatggcagttataacaagcaacacctttgaaatccatttaaatcgactactaattaaaatcatagacagcattgcaattaacactaccactaagttgtttcgaatcatgacagccataattaaaaaaaataacgctaccgctgttaaaccgattatccgcttttgattaattccaactgcaaggctacgaagcaatattcccatactaatcatcagcaaggcgactgaaatcaaatcgttatatacgaacatggtatacatcgtcaaaggaaaataagctaatccaatcacgatagtccacttacctaaattagtgcgatatttttcagccgacacagctaaaaacactaacgccaaatcgagcataataagctgaaacgcgggtataaccactagatgatttgtgaatcctaatgatgtaaacgctttaaaaataactgcccaaaaaacagcaatatttagattgttaggataaatcacgaaatagtgtaaccaagtattatttcctgatgctagtcgctcagcctgcgtaaaaacgtacccaatatcagtcgtaaggtttagcttgaaagtcaccaaatacagtatctgtaagcccaccattcccaaaataaatagatagaatagcacacgtttcaaattaattttgagccaccgcaatgtcatgatgccagcaaatataataattgatccacctatgcgaaaaattggcccaaaaaacggcagctcgtcgctggttcgaccatacatcggaaataaaaacattgccgtcaggctcaaaacaccaaaagcaatcaccccaagtaatagctcgctttttcttaagaaattattcatagtccctctagtcctaagtcgtttgttctgcgtaaaaaatgcatatgatataatcatataaaagaaactacgagggaacaacattatgttaaaacttattgcgaaagtagttgccgttatcgcggtacttggaattggtattggcgttggggtaacaatcaaccacgttaataactcagaacataccgaaaaaaaggcatcatcaagccactcaacaagtaagtcaaacgctagtagcactactagtgttactagctcatccaaagcagtttccactagcaatgcttcttctagtagcgttgctagtgtctcatcaatcagcacaagtatgacacaatcagaacaattctcagaagctgccaagtacgatccaaaccaaacagcttcaggtacagacattactgatgatgacattgcgaaagcacgagaaaaaatgatcgcagctggtttacctgcagataactttgcaccatctgacatcaaagacttaattcgtcaatcatcagaaactggtcgcgacgtcgttgatttggcaaaagaaaatttccaccaataattaattctcaaactctgcgtaaaagcagagtttttttcataccaaaaaacgtgtgaatagtcgcctatccacacgttcaaaagtagcttatttaactgcagccgaatcaaaccaaaccgtcttaccattcactacgccactataccaagttacgccttcaattgttacttgacgggtaatttgaatctgcttgttattttgaccagattgcataattgtttgccaccaagtagcatttgcaaagttccaaggcgcccctaagtacaaagcgtcactgcgattgaattgattgaatgtcttggtaaagttaactgactggatgtcaccaataacacggacacctgccttatccatccaatattgcttaccattagcatccgtatattgaatccacgtcacgccatctggtgtcgtacgttctgcattaaccgtcacaaacttattgttgtaccgtgatgctgaatacaaccacacagctccatcatagttccatggttggttagcatagatagcatcatttcgaccattttggttaattgaggcaacataatttactgttcgcgtacttgaattatctgcaacagtcgccgctgaatcgatccagtatgtttgtccgttcaaaacaatttgataccaaacaacaccattcgcgccagtcattttggccttcaatgctaccattttgtgactgccatcaaggttagctaaccaattcttccaatcctcaccaaagaatccatgtggcattgcaccataaagtgcatcaccactacgtcccttaagcatgacattgccactaagggcttgtacgtcaccaattttttgaacatcacgagcatccatataaacagtacgtccgttatatttaaacccaacccacttaatgccatcggctgttgtccactcagacgtcacttgaacagattgtccgttcgctttcgtcataggttgcaaccatgtggcacctaatgaccaaggcttatctgcataaagggcatcatttcgaccattctgattaatcttagctgtatagttcactgaaacgggctttgtgttatctacttgtatggcacgtgaatcaacccactgctcttccccatttacgttaacggcataccaagtaacaccatcagattgtaccgatttgttggccgttacatacttaccaactaaattagtcttcgaaaccggtgttgaccatactgcgccaacccagttccatggcgcttccttgtagaagacgtcatttcgaccgttttgtcttacgacaccagaaacatttacggatgcaaagttattgcgagaaattccagctcgatccatataaaccatcttgccattaagcttgaatccgacccaaacaataccatttgaagtttggacttccttggtgatcatgacgtgacgaccattgtaagatggcgcatcaccgatgtgcttgttgccataaacgttccaaggctgatcttcataaagaccgtcccaacgaccattttgggtgatagttgcaggatattgcatacttgcctggctagtaaccgtatccccgtccactaatgctgagtatccatttgattcaataactgaaatcaaagattgtgcatacgttggcgcagtagcatacttgccttgcaagccgtatgcagccgccttatagtcagaagcgttttcgcgccatgcaccagagtaaaacgcatgattccagctcaacccatttcgaattaggtcgccgttatcattcattgactctttggcgcttggatacttacggaatgccgcatcaatatagtaaatatttccatttgcatcatactcagccgtacgcatcgttacagattggccgttgtatgtacccttaataccaaaatagttattagcttcaatcgctaatgcagattgtccccaaccagattccagtgttgcttgcgccatcattactgatccatacagattatattgacgagaaatttcacgcactggctgtgccactttgttgataaaatcacttcgataatcagcatttgctgctggcgccgtcacatatgcagctcctaaagccgccagtcccattgtagaaacaagcccagcttgtttaatgatttgtttcaccatttttgcagtaccctcttccgcgtatttggttaagtttatttaaaatatgtatgtctaattcgaccaaataaagtcaagtatgccgtacaaattaaccaatgtcaaagcatttcgatttaaaaaacagctgtaacaaccacaaaccgcattctaatacgatgtataaagacgagaatgtttttgtgtcacacctgcaacttttaacgcttgaaccttaacatttcataaactttattttacctaaaaaagcgcccaaatcttgtgcgcttttttaggtaaaaatatgaaaaaaagtgttatttcacttcgcgtgcaatatagattggacgctttttaacttcaagataaatgcttgagatataacgccctacaataccaagcgccagcaactggataccacccataaatagaataataactactaatgatggccatccactaacagctgaacttgaatcaatcaacgtacgaacgaaaattataatcgcgccgatgattgacatgacaaacgaaagcagaccaagtagagataccaacatcaatggcgcttgagaaaaggcaacgataccttcaattgaatacttgaataacttccagaatgaccatgatgtagtcccagcaactcgttcaacattttcaaattctaagtatttctgcttgaacccaacccaagaaaaaattcccttcgaaaaacgattagtttcactcattgacaagatagcatccaccatttgtcgtgtcatgacgcgataatcacgtgctccttcgactaagtgagtgtctgaaatacggttaatcagcttataaaacatttcactaaagaaagttcgaataggtggctcacccgcacgagtagtgcgtcgagttccaactgcatcccattcgccagacgcaacacctgcgagcatttctggtagcaaatgtggcggatcctgcaaatcaacatccattaccacaatatagtcaccagtggcatgctctagtccagcatacaaggcggcttcttttccaaaattacgcgagaacgtaacaaaatgaaccgtgtcatcgtgttcttgcaaagccttgatagccgttacagttccatcgtttgatccatcatcaacaaaccaatattcaaattcataattagcaacttcctggtggaccttttccaaggcttcgtgaaatagcggtaccgttttttcttcattaaaaacaggtacaacaattgatagttttggcattttatcgccccttaattttaattcaacataattaattatacaaaattatacttgtttctccaatgttttctttgagaattcattggagaaaatccatggtaagtcccaataaaaaaggagattgaacatggcgttcaaatctcccttttgttatttctgaattgcagctgaatctatccaataaagatttttgttttcaagttcaatttgataccaaagtacaccatttccaccaatcatttggtttttaatagcgacaacttggccatccaatcccaactctttaactctaccagcccatttagacccataaaagttccatggcgcatcaaggtaggccccatcgtctcgctgactttgattaaccgttccagtcatgcttgtataacttatgtctccgtttttacgaattgcagccgaatcaagatacacagttttaccttcatattggaaagcgacccacattacaccagccgcagtccgccactccttggtcacaataatatccttaccatccagtgttttcgcagctcctagatatggagcgccaaaattccatggtgcatcaaggtagaggccatccgttctaccgttttggttaattgttgcagtgtagttcacatctttttgtgcacttgttacatcaatcatagccttagcatcaagccaaattagcttattttcaaaattaaaaccataccacttagtgccatctgaactagtcaatgactttacaacttgaactgttttaccatctagtttacttgctttgacagttcctatatatttggcgcctgcaaagttccacggcaacaattcatacgcaccatcatttcggccagaactttgatcgatgaccatcgacttattttcggtcactaaatcaccgaacttcttgataccctttgaatccatataaaccgtttgaccattgtacttaaatccaacccacaatacaccatcaacagtacgccactcattgattacttcaatatttttattatttaattccttggcagacattagatacggagcttcttttccccacggagcttcaacataaataccgtcagacctattagtctgatcaatcttggctacataatcaacttgcttttgcttctctgttactggcgtaaacgctgcagagtccagccaaattgttttcccattccaattaaactgataccaagttacaccattccctgcttttagaactttttttacggttacacactcaccgtccagcaaagatttagcggacccaaaccatgtcgcattcgtgaaattccaaggtgaattcaaatacgcaccatcatttcgttcgtcttgatttatcagcaatactttagattcattagtcgcatccgcaaccttcgaaacagctctttgatcaatatatgctgtcttaccgtcaacttggaaagcaagctatgttacgccatccgctgttcgccaagtactcgtaacttcaatatcttttccgtcatatgacttagccgttgcaaaccacgtcgctccaaattcccatggcttctccaaataaatggcatcatttctgttgtcctgtttaatcgtggccgagtaatcagttgtcttaattgcatcatcaaccgcgactaatccatttgcgtcaatccacaagttacgaccaccgtacgaaaagccataccaaatcgtcccatttgaaccattcatttttttagttacgttaataaccgttccgttttgtaattccttagccggcttgtaccagactcctgaaacaaaattccatggagagtcagcataaacggcatcattacgaccagcactctgatcaatatagaattttttgtttatcgaagtaacattggaaagcttttttatccctcgggagtccatatagactgtcttgccatcgtacttaaacgcaacccatgtaacaccatcttttgttgtccactcagaagtaatctcaacgtcctgattgttgagcaacgatgcagaaccaacattagtcccatcaaatgtccaaggacgatttgcatatagaccatcatttcgacctgattgctggattcttgcagaataatcaacagattttttattattatcaactgttatggcacgactatcaaaccagcgtagttgcccgttcaatgtagcaccataccaagtcataccatcgattttaatttgctttgaaacatgaactgccttaccatcaagtccctgagacttaatcgtacctaaatactggttacctaggaagttatttggcgatgttttatacacaccatcatttcgacctgtagatccattgctgaaataaccatttacatcaatagattgaacatcagaaagaccactaacagcgccctcatctacatatgcacgtataccgctcgtctgtaaccagctaccccatgtaacattgttcgtatttgagttttttgcttcttgatcaaacaaaacatgcattccgttgaacttatttgcgtattccaaaaaattggtgccgcttacgttccagggcgctccctcatagataccatcgttacgcccattttgattgattgttccaacctttagaactgattttgatgacgtaacagtatcaccactcgtcataacatttttataatcaatgttgacgtcaaaagtaccgcttactccagggaaatgtgaattactgttgaactgccacataccataatttgtaaaccacaagttatcagaacttggcgcatatggataagaggccatccaaatatttgaatccccaaacgcacttggattcaagccggtacttgagacgtaactttgataggtatacaaaatcggtctatgatagccatttgacttaagttgatttgcgaaggccattacattcgcctgaatatttccatgcttagttgcactatcttccaaatcatctgccataactacgtcatttccaagacctaatgatcttgcagcagacgcaaaataatttgcttcatcacgcgcaccggactcagagttaaactggctataatgatatgcaccaactgttaagcccgcagctttcgcatttgtaatttgagtttgtgcataagggttcttgtaatttgttccttctgttagtttaacaatcacgcccttaacgccataactcttcattatcttataatcattaactgttagattaccttggtatgaagcaacgtcaacgacatccattcttggaataccactctgacccgctgtcagatatggaataccatcagcatgtatcgatgtcacaggagataatacgagccctatcccgaataacattgatgtcgcaactgaaatgctcttccatttcatgcaaaactccaccgttcttatttttttatctagtctagtttatcacgcttttttgttcactacataaacttttataaaccgatgttgatgtgtaatctctagtcaacattgttacaaagccttgatcccctgtgataaataatatgtatgataaaaagaccaaccatcaagaagttggttggtctttttatcatctaaattttagtgctcttcatcgtgagcaaagttgaaacttgaaggaatcttgaattccttacgtacttcgttcaatgccgcgttgaagacttggtccatgtcaaagtaacggtattgtcccaaacgaccaccgaagatgaattgatccttgtgttggcgtgcttccttagcatattccttgtacaagttcgtgttcttctcgtcgttaactgggtagtaagcttcctttgaacgatcccaagtttgtgggtattccttcgtaatgattgtcacaccatcgtctgacaaaccatcgaaatgcttccactccatcacacgcgtgtatggcgtctcagcatcagtgtagttgataactgagtttccttgatagttgtctgattcgataacttcgtgctcaaaacgcaatgaacggtactccaactcaccaaacttgtagtcgaagaattggtcgatcattcccgtgtacaagatacgtgggaattctgcaatgtactcatccttgtgctcgaagaagtctgagttcaaacgaacatcaatcaaatcattgtccaacatcttctcaaagatttgagtgtatccaccaattggaataccttggtaacggtggttaaagtagttgttgtcgtagatgaaacgaactggcaaacgcttgatgatgaacgctggcaattcagttgccttacgtccccattgcttttcagtgtaacccttgatcaacttctcgtagatatcagtaccaatcaatgagatagcttgctcttccaagttacgtggctcacggtcacccaaatcagccaaagcagcgttcttttgctcttcgatcttagccttagcttctgcaggagtcttagttccccacatctcgtagaacgtgttcatgttgaatggcaagttgtacaacgtacccttgtagtttgccacaacttggttttggtatccgttaaattcagcgaattgacggatgtagtcccaaacttccttgttatcagtgtggaagatgtgtgcaccgaagtcgtgaaccgtaattccgtgctccgtgtgtgtgtacatgtttccagcaatatgtggacgcttttcaataatcaatgagcgctttccgcgcttagctgcctcataggcaaaaattgaaccaaatggtccagcaccaacaattaggtaatcatagttcttatcattcaaagtcatgatattcttccttttatagacaatatttctttgattaaaagtttatacatattactgtatcatattttgcgtcataattgacagaaaatagtaataaaaggtcgactctccaaaaagaaagtcgacctaataattacatcttatctttttcagccttcgtagttggcatgcccttttctattaaaatagcttccatctcctcacgcgtcttaaactcatatggcttcttaccatttagtttctcagcttcaccatcaagttttgctcgtccatgttcaataattgcaattgaacgaacatactcaggcttttcgtcaaacaagtattcaatttcaggattgaacgaaatccctttcaacgttgaagaaataatcatccccgccttcttgaatcggaatttaacgtgcttaccaaacaacgtgtgcttaaggtcaaatcggaaattattaatgattgtgtcaacataagcgcgacgccctacacgacgggcactaagaacacggttacggaactcatatcgataacgccacatacgtgatgcatctttttctagaacgatgttaccagggtaagtattctcctttgacttgtgaacaacaatcgcaccgggaatatagtagccacgataaacatcagctgcacggttagtgtactcgatatcatctccccagataaagaactccttttgtggtaacccaatcaacttcacaatatcacgagaaattaatactgaaacgaaggtcgcattgacaacttcaattgcaccttcgtcggcagccatctctggccactcaaaaccacggggggtaacaacgttcatccaagcaggtcgtccatcaattgatccccagcgaacgttagaagttaagaaccctgtcttcgggtgacgttcgtaccaagcaactaaacgaccaagggcttgtggttgtggaatagtgtcgtcatccatcagccaaacgtacttatcgttggtttgctcaccaaacgcgcgcataccaaggttaaatccaccagcaccgccaccattttcagttgcatgaacaacaagcaacttaggttcagttttcgccaaatcatcgaggtactcacccgtaccatcagtcgacatgttgttcacaacaataacgtgtgacaattcattcgtgtcttgtgccaaaaccgctgcaattgattccttaagcaattctagtcggttataagttacgataacagccgaaactgttggttgtgtagaagtttccattagataaagtccaccaattgatctttgaatttagtataaaggtgcaatccgataatataaacgattgcgacttcaatccaaaaaatagccagttcatgctttgattgccagaaccaagcttgattgaagaatgtttcacgccatccgttaattatgtaatagaacggattgatattagcgatgaaagtaataattgtttggaatccgccaaccggatgtgccatcggttggaacaagattcctgacacgaagaaagccagacgcaatacttggcgaacagccaaatcgtagtcaggtaccaggatattaaagacagcgttaaaaattccaaatcctagcaacaaaatcattgctgagaagaaatagtacaccgcttgtaaccagtaagctgtcacgtgaaaatgccccgtcactgccatactaataaacgcaacaatggtgattgtcagtactgctgggaaggtttggaagattcgaatagttggtaaaattgaaataggaaatttcatcttaccgaccaagccgatttgtgtttcgatactacgaatcgtgtctgaaaagccttgattcaacaaataccacattgagaatcctaaagacatccaaacaaagaatggcataccatcaataggagctgcgcttcggaatcctccaccaaagattaccgcataaatcaaaacttggaatagtggatccaaatagtcccatgcacgtcccaagtacttgtgggcactaacagccttggaatcataaatagctagacgtgtcgtcatgcctaaatacttcatctgttccgccagatacaagtacgtttgtttaatcatttcaatcatacgaacctcccaacaagtgcaacaagagctagcatcaaaaccaccagcattccccatagttggaatgtgttaaatccagtaaagtcacgacgcttcaagattgccttaacatcattctcagacattccttccgctagcaactccgactttaagtagtctaagttaaaactttgtcgagcagcttcaccagccaacacaaactcgtgttgttcttcaggagacttcattgtaaattctttgttgaatttttcatactcagctgtgactgactcagtgtcagcaaaatcaatcatttctccgtattgaatccacatcgtcttattagtaaacgaacggatttcttcgatgttgtgtgagacaaagaagatggtgcgtccatcggcaacaaattctttaatctttttcatcgccttcttagcgaagttactatcaccaacagacaacgcttcatcaataatcatgatgtctgggttatcgtgcacagcaatgctgaaccctagcttcgaacgcattccagatgaataatttttaactggctgatcgacgaaatcacctaattcagaaaattcgatgatatcatccatctgagcatcaatctgcttattagtctttcccatcataagttgcttcaggcgaatgttttctcgacctgtcaactcccaattcaaaccttcgttgattgctactacactaatttcgccatcaacactgaactcaccagaagtctgaggaataacaccggacaatatattaagtagcgttgacttacctgatccgtttgttccgacaataccaataacatcaccgtcgtaaacatcaaatgataaaccacgtaatgcccaaaagctttccgttttttcgcccgtaatagtcgccttcaatttttcttgttggctcttaaatagactaaattccttggtaaggccacgggcactcacacgaatttttttatccataaataggcacctttttctttgtttaattcataactaattaatcattttagcgttttttacaaaaagtagcaaggttaccacgaataaccttgctacttttcgaatttaattaatttttgtatcgtgccacacgagagaatgttctttcggatatttggactttttcactggcatttcgcaatagcataaggaaaaataccgtccagaatgcgccaaaaagtccgtttattccgaacaaaacagcttcagaaatcatatacgtagacacatatacacccgtcatcatagcaattacattgcctgttaatcctattttcactaatccgtattgccaaaatgaataaataataataagtccaataattccaaacgacacagcgtaatacgcaactgacatatcgatagaaatagccccataaccttcataaaccgcttcggctattttttggagcttttgaataccagagccaaaaaacaacgcccatgcggaatgctcactaacccattctatacttgcgttcccaaaaaaaagtcgaagagacaggaaaccgtccatcgctttaaatatagccgaacttcgatcaccaaggaataacaagcttgtcaaaaatcctgtaactaaaatgtacccccctgtaatcaatacccataatttaatccgaatatcttttttaaagaaaaccaaactaccactgaaaaccgtcgcaattatcgcgacaaaagaagttctggcccctgaattaatcaacagaaccagtccaaatgctattgcaatccatgatgccactttataattgcttctccttgaaagcaaattgaacatgctcagaacaattagggtcgcagcaaatccaccgagattattaacgttcatgaacccaattgacacgcgactcatccggacattacctatcattccttctagcaatgtttgcatatttaggttgatgtccgaagcataaaagattgaaaggcctcctaaaacaagtagcagcgcaacaaaccaaatttctacaaaacgttctaattcatctttgtaatgttcgaccatgccaatggcaataaaataaaaacttccccaccggaataactgctcccaggatagttgcaaatcaaatttgtacccgccacctaagattgatataccagttacaattaataaactcgccaataacgataaaatgtatttatttttttttaaattaatgaaaggaagcgttaatagcacaattattaatcctgctttatcattgatccatccagcatcaattggtaatgacgggacgaaccgcaacgtaccaaaaacagcaaataaaaaaacgctcatatccacaagcttaccatacaagaatttatgtgttaccagaacatcttgtactgaatttacaattttgtgcatataataatcccctttagtctccgatgataatactaatatgcgtcacatctattcaaagagttccagcgccataacaattggtaaatccaacttacacatctttaaaatacaggtgtgaatctcttatattcatatcacaataaacacttggcataaactcaccaaaaataaacttaccaaacgataacctcatcgttgattgttgttcggataccagattccatcccgaaagttgtcatatctccaccaactcattactaaatccttaaattgaggattgtcataaaaaacttaaaaggggattttttgaacttttacatccgggtaacgagtaccttaaatactgagtaaagaatgagattatcgatcaccatacttatccagtaggcctactcatataactaataaagtatataaaaaagacggtccaatgtgaaccgtcttttcgtcatcttaatgatttaaaaacactcattgtaccgtgctaggttgtgtttgactattctcatctagctcagaatcattgtcattgattatcgaactagtcgaattagcatccatagccgaactgctcattgaagtgatgctggttgaattacttgcttcctcatttcctgagggtttagtaatacctgaagttgatgatgattgctgtaatgatgatgcgacagaactagaaattctagcgttttcagctgccaatgaagctgattccttggcagctatagcaactgattcattcgcagcggctatagctctactacttgcagcccgttccgcagttattgatgcttgctccgcaactaagccatcaaccttcttttgtattttcgacatataactactacggatgctatctaatttcttttgcgcatcgcgctgttgtaattttgttagcttatacggttgcagtttatatttagctacttcctttgacgtatagcggttcttttttagccaattatcaaaagtcacaaaatattgagaaattgccttcttcgcattggaatcatgagattcaacaaaatcaatagcatcttccggtgttttagcaacttgaaaaggcaaactacttaaatccgtgtttacgtccgccttttcaagggtatcgtcagcccaccattgttgcgaaaatattacacgattcatcacttgcgtatttaaattctcaactgcgacgtcatactgttgctctcttggagaagcgtagcttccattaaaggacagccaaactagtaacgatattagacctgcagcgaaaattgcatccagtgtacttttaggtctgaaaatccgtcctacattcattctttagttacccataaatttcaaaataatttttgccaacgaaatagacagcactccgtctggagcactccgttttcgatacttacattttaaaattaaccgaaacacactaatagtaccttgcactaggttaaggtaattactttttaagtaacattagcagtcgatgcataatgcatagttaatctcagcgtcaataccggcataagccccttaaagcatcgatttttttgacaaaagtgccaaatttgttctcaatagttatcgtctatcaatacagcgctttcaaagcgtaacgtctaatacgtcattctaagactgccgaatagtggtaatttgcttaattcataataagcgtgcgcaataagaaacgtaacagcaacagtaattaccaaaaaaagaaacccatcaatattagcaggcaaaaacttattcaccaacgccaatgtataaatatggatcacataaattatcgagctaatactcctggcatatgccgaaatttctgcgttaatgataggagtgttcggtatctttagtaatcccataaatattaataaactcaaaggaaacaaaaaaaacgtatatgaggcgctatgacccaatccgtatcgttgaattaacgaattttcaacgacaaatccaactaatgccggaagtatccaccacaaagaaattgttacttgattttttttaacaaacattcccgcaaacatccaagggattccagcaatgaatgatgtgtataaaggaaaccaagaaacaatttggtcaacatgagggataaacgacaataagcttgtgtagcccgaaagcaacgtaaataccaagtataaaataaccgaaattagcgttagtgccttcttatttttcttcaccatcatatacgaaataaataccaaagagataattgtagtgaggatataccaacctggtccccatcccaatggtgaaataattaatgatttcagaatcaataaagcagcctttaatcccgttatcccctgaaaattctgaactaagcctaacggtaaatatacgatcatccaaaatatgtacatctttaataacctaataattctcttcttcattttgggaacaaagttgtaattatcaaagttaacattaccgagaacaaaatatccagtaatcaacagaaagaaagggacagctatcctaccaaaatatacattaataatttcccctaagataccactgtttcgtatcatttcactatgaatgccgaggacaagaatagctgctattaccctgaataagtcaatcgcatcatacctttttgtaatcgtcattttcgtcttttaatcctatcttttctattttattagatggagaacatatgccaatgccttagcataattcaaatacccatatgtaaaaccataatctaaaattgcaatcaatacaacagccccaattggagcaacaaccaggcttatatgcttacttccaatctgtttaataagactactcaaagtatactcatacgccaccacagcaatcatcaaaataaaaataacgacctgtatttgaattaatctttcgaaatttcttgaacttaacaataagacatctccaataaatccgataaaacttacggcgtaaagaaagcgaattgtttttgctacttcttcgcgtccacgagtctccataaaaaaaaccacaaggcgagaactaaccaataagaaatatgataaaatccacattaatcccatgttccatcttgcaagtccgttcaatgaataaaatcgaattgtagattcgatgttcctattagtaatccactgcggaatcaagtgtgaaatttcaataaaaaatgccgtccgattcggaatgaagaataacacgcccattaaaattgaaatagccggcacagtgtacatcactatcttgtcctgcttttcaggtttaaagcagctgaatagtagcactggaataaaaaacaacgctaatgagtggattgtagacgctgctacaataataccggttcctacaaggaacctgactatagtcctttttttgagtacagccaatgccaaaaagaccaaccccatcattacaaaagtgcgtaacattgtaatttgaataaaaaatggaaaaagtaaatacacgccaaaaaaaatcgacacgttagcattcaatatgttcaacgccactataatcatgatcaaagtgattataatcagcaacgctctaaaaacttcaaactctatacccaaatttcttgcggcgttagcgattatggtataacccttctccatatatccactacgtgtagggttgttgtaataccatttatatgattcaaaatcaggtagttttggagaaatgttaataacgctcaatccgactgcaaagaaactagctatcaatccaggggtccgatattttttctccccagccccataataaattgaaaatgcaagcactccgatatacaaaatagcaatcatgcctttacatcctccaaatgcattttttccttcaaatgcaaatagagtttctcctgaaactgcttagtaaaatgcaatccatctgtcacagattctagagcgacatccatcaggatatcaaggaatttcactccgtccatcttttgaatttgcttattcaattctttgattttttcgttagaaacatcaatccgtccaaacgcttctagcactggagttaccattacctctgagacatttttttcgtgaagtttatcaatcaattcaacatactctgagaaaataaaatcatcactcttatcgaattttatatcattaactccgagtgttatcaggaattttttaccttcaatcagattatttgagatgtccataactgcttgttttgcagcagagagagtcatgccattaaccgaaagattaaggacgttcgagtttttaaactcaacaaatcttgaatcacctaataaaactactttatcatcactctcgtcttcgttttcaaagaacaatttgtgtagttcttcagaaagcttcttctccgatttattaacatccttcttaaacaatgccacgccaacagccgttttaaaatcgatttcggaatcaatgtctacaattgattccggagacattactagcggtcgcgttgactttgaaaagaacccaccatattcaagataattgcgcttagttgaaacaaataacgtcccattaggtatatactgtcgctcaaatttctgtcttctatacccctgatcaaccttatccaattcagagacgaatccatcctcatctatcttagtaattaaactagtaggctctgtcatctccgaaaagccgacaacggaatgcgctcttgtactttccaacaactgaattgccttgattatttcatttcctgctttaaaaggagatgtcgcctgcaacaaaacaaaaatttggtcatcatcaaacgaaactagaaaatcttttaaaacatcaaatgttgtagccaaatctgagcttaaaaaatcatcacgctcaattaaatgcaaattatcatgattaaatcctgcaacatttaaatactctctggaatcagatgacacataaatatcagattcagcaaaacctgcttcaatcactgcatctatcgaataatgtactaacggtttcccgcccaacatcaaaatgtttttatcaggcaatccttttgatccacttcgaattggtataaaaaatactggtttcatcgctaactcactttactttttttgcaggaactccgacgtatgtgcccgattcattgattgtttgaacaactacagcgcccgctccaactactgtccagggtgcaatcgaaatcacttgaatcacggaactattcagccccatatacgcgccttgcccaatctctacaaaccctgcaataaccgatcgtggagtcatatttacatgggcatgaacttgcgaatgatgttcaactactgaatatgtgtttaagattacgtcgtcgtggattgatacatacttccctacaaaggcgccactaccaataaaaattcctcgtccttgaattgacttttgacttaacacaattgcagtaggagaaacaatattaattaacgcatcatagtgatgctcagcaacatcgttaaaccattccgcacgtttttgattatcgccaactgtaatgaaaaccgaatctatcacaccatcgtctaaagctttccctacttctgaagtgtgaccaagaataggcaatccatcatgcgtgtcgataggtttgtcatcaaaaaagcctacaagagtatactcacttgtatcaataaatgggcgcacagcatccgcgtgactacccgcaccgacaaaagctaattttttcatatctcatccacctatatactaaaaggaatatcgaaaaactttttcctagagtctcgcccagtcttcatgtatttatcgattgcaacggtcgccagctcaacagaattaggctgatagtatggattgaaaaaacttgttacgcttggcacaatcttcaatgcttcagttattgctgcttcagttattgtgggaacctgaatgacgcttggcccaaacgctcttcccttttgcctgttgcctaaattaaccgtaacagttccaagactcggcgcctcaattaggccagatgacgaatttccgagcaatgcatacgcattttcaattaacgtatgaaattctccggtaggcaaagaggctattctaatcacattcttctctaacttactaaactcccctaaaacaacatccgaccctgtgtccacgtttgacccaattaaaataatatctttctcaagagcctccagggacttacgaacagcttcagcctgttttttaatactttcttcgggcagatacgtttctggatggaataatactacaatgtagcttcctatatcaaaatccagcccgtacttagttttaactgtgtcaaatgatgggcgttcttccattaatacattctgaacacccaaagcacctatgttcaatacagattctggttcttcacccatctgaataatgcgtgttcggtattcctcggtacttgccaaatgtaggttacttaacttagttagggcgtggcgaattgattcgtcaaagtttcctaacgtctgttctccaccatgcaaatgaattataggaactctatacaaaattgctgcatttgctacggccaacatttcatatcgatcacctaagattattacagcgtcataccgtttactttcaaaaacacttaccaatcccaatgttagatacgctaacccttttaagctcgtcttatcacttgagtcacttaaggacataggaatttcgctaatcaccttaagaccagattctcgaacgaaattaacggtattaccaaagcgttcttccacttgcatacccgtggctactatgtctacaacgtactcatccttggcatttaattcctttaaaaggggttctacgataccaaaatcagctctagaacccgtaacatacaaaatgttatacattttttactcctgccattcaaaacgttcatctacaatcagatcatcgtatttgaaatcacgttgtgcctctttacctaaaacatcataccagcgcatcggagaaatgccgtttccaggtcgcttgactgtaatattttcttcagtaaacacttctccgcgttttatgtcacgacgtgcaacgatagactttcttgcaactattttattgaaaatttcaacttcaacagcctttttgtcagcacttcccatagcttcttcaattgttcttacgcctgaaaccaaagctgaaagaacgtcgggtgtggcactcgctttctggtcaggaccagggagggtattgtcaattgtaaaatgcttctcgatggtcgtagcccctagagcagcagcgcctatggcaactgcatatccaagtgaatgatcggatagtccaatctgataaccatcaaaatgatgttgtaaagtcttcatagcatttaagttaatgtcagctgtcctagtcggatattcagttgttgcatgtagaatcgtaacatcatcagttccgttatttttcaaaacatccagtgccgcctggatttcaggaatagttgccattcccgttgacaaaataacatgtcctccaacttttccaattcgctctaaataaggaagatttgtgatttctcctgacggaattttaaaagttgtcatccctgattggatcaaaaattccagtgaatccatatcaaacggtgtagaaaaaacatcaacgccgatttctttaccaatttctactaatttcaaatagtcacttcgatttaactctaatttttttgtcatttctaattgggtatcttcatctcccgttgttagaatttgatattttgctttaggtgcatttttcgaaattaattcttcagcaataaaagtttgaaacttcacggcgttcactcccgtagaagccgccgcacgcaacatcttttcagccaactcaaatgaaccattatgatttgagccaacttcagcaattaaatagaccatctctaccctcacttatcattctttgtaacgtctaatcatattgtatgaatacaataatacaataaatatgccaccaatcatcaccatatatctgctatatgtttgtccaaccacaagcatttgtatggccgaataaactgtcatggtaatacctgcaattgtgaaacgaattcctttaaacaattgataccctaataacttttttgccataaaaaaatgtccgaccatcagaattaggtacgtaaataatgtcgaaaacccggcagctacataaccaaacttaggcactagccacagattaatcacgacattaattacggcagctacagcagtactaataccaataaaaccagtcttttttaaaacaaactccgcattcacaggaaagccatacaaaaattgaaaaaagtaggctaaagtgactggcataatcaaaaaaattcccgcttgataactatcagttcccatgtatcgtgctaaatcaactgagattggcattacaatcattgtcacaatcataaacaagctaataaacagtgtagtagtctttgtgatttcgccttttttatcttctgaaaactttttaaaaaaccacggaacccatgcattattagctgccatccaaataactgaaattatcgtggctacgttgtatacaaaactataaagtcccacttcgacatcaccgcgatactgttgaataataattctatcgaactgcgataacacaaaatttccaacagcgtgtggcaacagcggaatcgatatcactaaagcaaatttccaatatttaaaattaatattgagaccaccctttagtaatatattcaagtatagtggtatggccaacaatactaagccgactgtacttccgatcactcgcccccaatcgggattaagggaaaatattgttaacataaaggtcacggaaaaaaatacattaaagatagtcgaaagaaaactcaccagaatgttttgcaagtatttattctgaatcattaaataagtcgattgaaaatttattacgaaagtcacaaaactctgcaataacacgaataataaaaacacgcgattcacagatgaactaattaaattcaatccgacaagagaaccaacaacaacgattgcaaaaactaaagtcgcaagcaaaagcaccgatgataaaaagtttttaattttatctttaaaatcgatgattgcgttatttatagcggcatttaaatttaatccaataaaaatagaaaagacactaacccaagcagcaaagttattgacaaacccgtattgctcaaccgttaaaatgtgtgtgaacaacggaatcgtgaaaaaatttaccccttttaatgcaaatgtcgcaattgtgtatgccccaccagatttaactaaatcattcttcattaatttttttaacattttatcttcgactactaaagtttataagtgtcatactcctttgtgtcgtatatatattcatcagcactaacgctttccacggcactactaaacacgcctatagatttatagaagctgattccattgaatagaaacatctcgctaggaaaagtttgttttatcatcatgacattgagagatgaattccagttataatcaaccggatcagccggatgcaattttaaaattgttagttcattcttactagcatatctttcaatcaatttttgaaagatttgcctttgtctttcttcagatgaaaccaggccatgcaagtaaaaaggctgagtaaatatgatgtttaacctagagtactgttttaattgtaagaataacggttccacatcaaacagttggttaagaaattttaagttttggtctgccttaatcgcatcaaccaaaaaattccaatcaattttctttaagttttgtttccacaattgaaatctgtcaggataagagacaaacgtattatccgcatttaaaagttgttgtggccgcaattcgccaattatgaaatctttcaaaagacggattttggacatctttttttgcggaagaagatacattaaggcaccatcctcccaaaactcaactttatctctattcttctttaaacttaacacgcgttgaattggcttcgaaaagcgatccaaataccaaggaaaaacaataatcttgctaaaattatcgaattcatgttctttaataactttatcgatgcgaagcaaatgcttaagtttccagcgcaatccaaccgtgaatgtgatgaactcaatatcatactgatttgcaatttgattcaatagcgtttccattccttcaacctgattttggttttcaaatgttaaataaaaagttgcttttgtaccatatgccaaagagtgactcaatgcaagaatcaggtgatatctggtcgttataaaatacgcggttttactatcttttttttcaattaacatacttgccccctatctttttagcgagatagaagaaactgtatcttaatcttatcccaattgggacgttatctcgtatttgccggatcaaatgttccgtcgcatgctgcatttctcgtcgcctttttctatctataatagatagtgaatcaactaatacatacataaggattacatacaaatatttttctttacgatacatcatgagcgatgggtcagacaaaatggcttcaacattttctaatctgtcaacaatcgactgattatcaattgtggtggtcaaagaatctccactctcggaagagtattgtctataccaataagttacacctgtattgatcagaatagctttgttcacgtgtttataaaccctatacgtgacattcatatcttcagcaaaaaaacgtcggttagggaagcttatgtcgttcgttgaaaatatttcttttctaactatatacgcccatacataattctctaattttctctcaaacaaaagagttaccagttccgcccctgtaacgttttttagtgacagcctctcctccgaaacgtcattcaattctgaaaactttttaaatggtaactgaattaagtcaaactcattattttctatattaatttcaatcaggttcaacacctcgttcaagctttgaacactcacaaagtcatctggatcaataaaccatataaaatctccggatgcctgatcaatcaaccggttccggacaatcgatatacctgcattatcctgtctaagcgctttgatatttacgattccatttttatttaaaaatcccgttacatttgacaatgaatcatccgtcgatccatcatcaatgaaaacaatctcaacgttttttttgcgcattttaatcaagctttttagcaatggttggatatccgtggacgaattgtataggggaatcaaaattgacaagatataattagacattatcatgtaacctcaacatttcagttaaatctataccgtccatacttgcgacttttcgagcgaagaaatacttatcactcgcaattttagatagggtcgttggagataggttttccggtgaatttcccacaaacctataatatctgaaattctcatttcttatttcgaaaaaatcctgattttcgtatagcaccgtagtcttataaagctcgtcaggaaccaaagtgtttgcaaacgcatctttaattttttgactattttgtaccaagaatgtcacaaattgatcagaaaacgatccccactgagaacccgcaacaatctgtttgaacccaacgtttcgatttattctaattgccttttgaaaaacaagtaacgctttttgcagcatccaaattattccgtgctttcttacaccaaactcagttaatggataccaatatctaactcgattttcatattttttcgtgtttatttcccaaatatcaacccactcacctgacgcattttcaaaaaaactaaatacttgtttagggtttttagtaaaaacgtccgcaccactgatcaaatgataatacttatatccacgcttattcgcttctttgaacaaatttaattctgcagccatcagactaggcgcagcccacgcagttttaattcgatcttcaataatgtaaacattcgatagttgcttttgacttagccaagaagtaaaactatcaaaacgactctgcgacatagacttatcaaaatgaatatagacatcaaataaatcgtcaggaactatctcaagatttgatttcaagacttctgatgccatgtgatctaatattaaaatcgcttgtttcaactcttcatctctcgcttcgtaaaaaataagtgtacacaatttttcgtagtgatactggaataacaacattaatagtcatcattgccaatgatacaccataatctaatcgactaatgtagccatcttgtagcatttgtttcttcagtcgacgataagtgaatagatatcttctcccgccacgacgcttatgcattccttcacctgttcgcatcttaacaatcattttatcgagattcttcgatagatttccttgctgtaagattctgacccataaatcatagtcttcaaacccttggaaatctcgatagtttcctgccttaagcacagtggattttttaaacataactgctggatgattaaatggatttctctgttttgagaatttcataatttcattatgagttaatggcacttttcggagagcgtctatttcccctggatcttcagaaaattccccaacaactccgcttaacaaggtaagagtcggacttttctcgaattcacggacttgtacaagaaatctatctggaagagataaatcatcactatctgctcttgcaattagttccgtcctagaatattcaaccccccttctgagcgctaacccaagtcccacatttctaggaagagcaatcgttcttacttttcctgggtacttgattttagcgccagttagcaccgtttctaattcttctgttaacggcccgtcctctatgataagtaactcggtaggcaataaagtttgattaaacacacttttaatcgcctccgataaattagccgatttttcatttttataaaccgacataagcacggtgaagtccattttgtcacctcattgtttaattcaatatacaagtaaagcatagcggactcaccgatgtgaatccgccatgctttaaggattgccactgttatctggcaccttctccagtaacgacagttttaattgtcataaatacaatcttcaaatcaagtaacaaagaaatattattaatataaaaaatatcagcttctaatttttctgccggtgatgattcataaccacctgttacttgtgcccacccacttagtcctggttttattcgtaatctttgttcaaatcccggaacggtttcagaaaattcttctgtgaatgaaggacgttcaggtcttggaccgattagactcatttcgccagtcagaacgtttaaaatttgtggaagctcatcaattcttgttagtctaatgaattttcccacttttgtaatgcgtgtgtcatttttttgagcccacatggcacctgtttttttttcggcatctgaatacatcgaacgtaatttagtgacaaaaatgcgttcgcccataaggcctacacgctcttgacgataaaaaacatcgccaggcgtttctagcttaataagaagaccaaaaaaagcaatgatcggtattgcaatgattgacaacagtaacgcggcgataaagtcaaagaaccgcttaatcacaatgtatgtagattgcactggagctgatttttgtagctttttctcatatccaaactcaacgtctgtatttttttcaaatcccatcactctaaactctcccaatacaatctaacaccgctctcaaaagaatatgccggtgaaaagtttagtttttctagcttgtcaattgatgctactgactcctgtatatctccagttcgccgtggcgcatccaatctacgtaattttttccctgaaactttttcgaacgtttcaatagcttcaagtaactgcctagaatgaccagtcgcaacattataaacttgcccgtcttgttccatcagtagtttcaagaatccttaatgccctgacaacgtctttaacaaacacaaaatctctagtttgtcgtccatcccccatcagtgtaaacgtttcattttttctcaacgtgtcggcaataatacttaggacacccgaatacggtgatgcaggattctgtcgtggaccaaacacattgaaaaaacgaactgcagttgctggaataccatacaattcagcatacgacaaaacaaatcgttctgtagcatacttgtcaattgcgtacgccgtagctggtgctaccggactaacctccatcttaggaagttccgggagattaccataaacagctgctgaagaagcaaatagcaacttcttaatttctaaattattcgcacggattgtctctaaaatgaataaatttgcctcttgatttatttggtggctctcgtacggtcttgcaattgtatctgcaacgcttgcgatcgctgccaacaaataaataacatcaaatttttctgtaacaagtagtttttccatgaattcaaaattcgcgatactctcttgataaaatgtcacacccgacatatcttgaatgtttgttaaacttcccattgacaaatcgtctaccacaacgatttcatgtccctctttttggtactcttctacaacgtgagacccaataaagcccgcgcctccagtaactaaaactttcacaattcactcctgcattttaacgtgcgccacccactactctagatgcactacacacttgtattgataagccatctaacctcttaaaaaatgtatatttcaccagttaaacgggctaattttgacaccaaccttaaattcatcttatcatacatttttttaactactataacaatcatgttacgttgtgcggtactaaacaaagttaagcaaattaaattttttaccaaggaaatttcaatccatatacgctttgagataatttcacccgaaagactatatctaaaaatttgggctaagaaccaccaatttagttatgggtgtcaatctctaaaatttattatccaatgaaagcaatgattttttccaatctgcgatgacacattgttaccatcagccataactttgtacttcaagcaattgtaagcagcaaacgcagctcaactgtcactttatttaagctatttaatgttatttgactcagaaacagttattttaactttcgttgttttagattcgttaacgtagataatgttcattcgcaagtctctgcccaaaatttaaaaacttagaatcagcttaattctggataccaatcttttccggcaaataattaagtacaacaattctctgtaataagtcacttgacaattttttacgtaacttttagtactctctcttcgctcaaaagtccattgaaatcagtaaccattattgtgcacttaccgtccataactatcagcgcctgttttgatacaaagaatagattactgcgagcgtatgcaaaatgatttttaaaattccggaactacttccccctctgcaatcataatcactagagcaatgactaaccaagcaacaaattttcagggcgcatcctgagaacttgttaaaactggaactcttacacggaactattttactccataaaaacgtcatccatatcgttagtcataacctagctttaactaactagttgattactcttttcccagaaggcagtcaaaattaatagaacaagttgtaatgctactaatccggttaatatatctttgatattaattccataaattttaccttgacccaagaattgcaatactgccgtttaagatatcgcaaaatatctatacaaaactaatgcggaaaccgctattctttaaaaatggtgctaccaaatcgaaaattttccttttttgaaagctgcccaaatgaccaagattctctagtcatggaacatggatatatcggcttgcagtccacctttgtttgtacaccaaaacgcagcctcgacccaggcaaaaaatatgatcaaccataaaccacgtacaaaatgcttttattcattacttaacccctaattatcgtcgattttcacattacagaataccctaaatgatctctaagcttaggaacaacttaaagagtcatctaatcagagtagaactaagcaaaactatttttgattcataacgatagttaacgtatcataaagacttaatgtataattaagcgacataattttaggagcatctacatttcaatgaaaataaacaaaaaaatttttacaaaaacaattatttcattataattatcatttctctcgccattatcagccctcagattattaatcatgcttcagcatttggggttgattctctgttccaatataaccgtatttatgatgcgatgcgttcatggaaaacaaatacattttctcccatatctttatttggttttgactcagttggtcgcgttgcaaatgccctttacggtcctggattaattaaccttctgggaatttttttgcttatttccaaatcttggtttggtttccaagctctgacaaatttcttaatgtattcaggttctggaatcatcatgaacttttcggccagaaaaattggcatttcacgaaaaaattcattattgatagctaccctttggatgcttgggaatcaatggacagtaaactggcaagttaacacctccttctcagcctggggatcgttgcttttgccactacttgccatatcaataaaaactttgcttggaaaacgaaataattttattacttatattgtttggcttgcattcccgatcgcactacttgtacaggtacacgttttctctgcattaattggaattctaattcttacgcctgtagtcttatatcgtcttttttttaaaccagatatcgtatttacgatttccttaatgatatcgatttttcttgttttacttttgagtggaaacttcataggggctagttttgaattctttcaaaattctctcattagtacagtaccagtacctttgactacaggaacccgcctacccacactaactgaaaacatcggcaacattgttgttatctcagcatcgacattaatattaataagccttgttttcagattccgaaactttaaaatagatttttcaaactataaatcggtatatgtaataatcctagtgttctttgcttttctgagttcatcactatttccatgggtaatagtttctcgattttttccagaaacaatgtcttttattcaatttcccttccgtttttatgtcgtttttctactgttcggactattaattttaggaaatgaacttgataatccttcctttgtttttgttaaagaattacatgttttaacagtcattactgtcgtcttatatatttttgctggactaagcgtatcaagcaacattgttaaaacttattatgagccaagttttataaacactttgaacacgaatagtcaaaatgggtatggaacaatcaaaaattcagaggaagcacgcaacctcttcaaagttgattcttcaaaattaatacaaactttacatggtggtacaccagactacttacctcaaagtagtcactataagaaccaatcagatatcagtatataccatcgcggttggacgaacgtcactgatccatatagtttatacacagaagcgcttagagaaagaagcaaagatgtagcgaaggcaatatctcgaaatacgattgttgtctcatggagtcaagataacaatcataaaaaagatttgcctttaatcatctataagaactctaaaattgagctcaatggtaaaagtttacttgtatcaaaaatccaaacaaatgatataggttttatttcaatcaaagcggcagcgggtacgaacattctaaaattgagctacaatcctggtgcgttttacacatatgcggaactcgtctctcgaatttcttggttcagcttgttattattacttttctactctttcttaagaaaaattgctcgatattcgctagccatgtgaaatcagccattatgcttacagttgtgaatatcgatagacttttttaaatatgatcaaatgtaatcaagtccgtcaatttagctttgattacattttaaaaattttagccctaaatttgcatacactaaactcgtcaagcaagctgtcaaaatatcataaaactgaattaggcgttcgcgtcttctgaaatggcctcattccggtattcatacggagtgaggccattttatgtttctgaacgacggatgttgaagtaatcaacacctattttgcccactttaaaagtgtcctttattgttaataatatctgatttgtcacactattcgattcattccacagcttctcactcttcacgttattgtattgcacgcctgcaatagacatatttattttaacgttgtgggcattctgcagcgctaaacctgacaaaaagtacttgccgcggtcagtgtgcaaaagctcgtcggttaaatttcctaacataataaacgcttagtagaatgcctacactagtgtcattgaggtttctgttttttatttattagaaatatttaaggccaaagtactttactatagaactcgaaagcaaaagtgtgggcacacatgaattgtgcaacttagcgtcattaaatctaataaacctatcttcgataggttaaaacatgttgtagcaatcatgctgcgcgaaaacgttagtttaacattaccttgtacagcggcgtatcaacgcaaattgtagtgcgtgtaaccaattgcatatttatttacaacaaattcaatttcaatcatcgctccagaacgtcgcgtttgatggtttcaaatcagacaagttcactactgatggaatcagcattcccttaattgattcagtgcccaaaaaccacgtatgatcgtgttctaggtcaactccgttcctatttcaactaatacatccccgtaaatatcaagaaaattttcatcacgccgtcgtttaatgataaagaacttattgaatgtttacatgcactctctgagcagctatgggatgcaaattctttgttgctaatacattcttttttacgtcattgaaactcgtaatgaatctgaactaaagtgtattcgatatcctgccaaagtcgatgctaacattgatcattaacaaaggagaaaaaactctcgtcgaagaactacgcatatacacttcgtaggaatgctaaacagctgtctctattgattctcaactggattagttgaaggttcaaacaataaaatcaaaaccgttgaacgctcaacgtacatgttccgtagtttctaaagttttttctacgtattttcatctcattcaaaaccatttattctttcatgaactataaataaaaggtagctgatctcaaaaatatgaaatcagctacccaagaaaggattagaatattaaatttaccggttctcagtaccatttgactttgaacagtttctcaactcacctcgtactacctaaaagtcacggtagtaacattaaaacgtatcaccaatcagctccgaggaaggattattttttcgaaaggtaaaagcaagtacagcagcaattaaccagctaaaaacagataacataagcaaagtatcatacaccttttgatgcttaaattgggtattaataacaatctgacttcctggcaaaatttctttatttacacttaacaagcctctagtgtttgtagaatctattttttcaccatttatcttcacttcatatttccaaccttgatatgtaaacataggaatttcagcatttggcttgactttaaattcattgcgcatcacaacttcgttactaccaaagcttcgtataatgaaattagcattttgtccacctgttacgctatgaaaaagaaatacatttttcccttcttcagataaggcacctgaatccgttcccatggctgcaggggcatagtcctggacagcagttttagtaattctatcattttgtaaatcattttcgtctattaaaaatgtacctacattcgtgtcaaagttctttggtaaagtgttcgcaatcgttgcagttcgtgaactatacccataagcaaattgtgtagaagctaaaatcgttaccccactcattatagccagtatacccatccatctttttttagatgatatacgacttagaattaaaatatggcactttatttataaacgcccataacatgtcttgagaactatatagcacaagtaatcctaaggtcagccacgcatcttcgttcctatttcctaccttaaaacataccagcccaacaataattaaaaggaacatcggagtagcaaaacttgtacgtgccccccacgttgtttccgttaccaactttataacgtcaacgccgatgacatctccttgtccataaggcattaacatcttattttgaattaatacagcatatcgaaacaaaaaaggtgaagccaatatcacggcaattactccagcaaccgcaccattcaacaataccgcccaatttcttttatacaatttatacaacaagaaaggaataaccaacattaaatagacaatcacactgagcaaatgatttaaactaataaatcccgctgccattcctaattgtattgtaattctccaattaaatcgtttttcatttaaccaatccttcgttaccaaaaaaatgggtaatgcaaaagcataaatcaaggctgtatttggttggaattctctaaaagctgtatacaatgcgtaaccagaaagagtaaaaattaatgctaaagatgctaaattaaaatctgcaacattatcattccttttacgcaacactatatacgtcacccaaaacgtaagccataacgttattattcttatcatcaaaatctgatgagtaaaagagagccaattagtgataagcacgagtggccaaagaaaaaaatcaggatacatacctggaatggctgtcccaacgtgatgaaaagtagtcatagcgagtaaagggggaatgctgcctgatttgaaagcatttcttatttctaagatacgtgacgcatgaaaaaaagtgtccccagacgacgcaaaattagggaactgccaataccaagcaatgattcctactgtccatagaatgaacatcaaaattacatttctacttttcaaaattccaactcctaaacaaataaaatcgatttttcatttttctgagacatttcaatctgattgggaaaattcatattccacagatttcctagcataattgcccacctattctagagggttgttttttccttcacaaatagtgctcacgacggaaaagtatatcatacttgcccaaaatataacattctattctcatagatccggcggttgtcatattttcctatttcagacttgttaataactccaacaatacctttcttacataggtgttttattctaagtgaccacctactttagtacccaaaacaccgtacttaacgttaaacataccgtcaatggtgcattggttaatcttgcttggcctctcatataaatcagtcgccttttcgcactacctaaatgcatataatctttgttcgatatagtagaaatccatgcgtctatctattaatctcttcttataaatgattaactctataaaaaatccggcttaatagcccacttacgcggcactacaaaaatctccttattcacattataacgaagccttcttaccaataacgacgcgtccaataatcagacaatgtatttcatgagactttctgaccatctcgatcaatcattttttaactactataacaatcatgttacgttgtgcgttattaaacaaagttaagcaaatcaaattttttaaccatgcaaattccaatccataaaagcatcaagaacagttcgccaaaaaccacatagttataataatttgggccaaatacctccactttaattgtggttgttggtctgtcaaattcattgtcaaatgagagtaatgatctttcgctgatgtgtgatggtacatttttaccatcaaccgtaactttatatttcaaactatcatatgcaacaagaggcaattcgacgacacccttatttaaactatttagtgagtacctaatgatatttaccttaggaacggttattttagttttcattgcttcaacttcatttacgtaaacagcgtgttcatttgcaagtctctgcccgaaatttgaaagtttagagtcatcttcactctgagtaccaatcttttcaaaacgaatctactctagattggcgcgacactttaaaacgcacctttaccactgataaccgcgccaactgtcatgaacataatcttaaaatcgaaccacaaattagcattttgggcgtactcaatttcaagatctgctcgttcaggatattgaatttcactgcgaccggttgcttgccagagaccagttgctcctggcttaactgacaacaagatatcgacatcatccccatactctttgagttcgttttccacaacaggtcgcggaccgataattgtcatatcacctagcaacacattcagaaattgtggcagctcatcaattgatgtcttacgcagaaatgcaccgaacttggtaattcgaggatcttcttcagtcggtaacttatacccatttgccacgaacttggcataaagttcaggattgtttaacaagatatcagtagcaccgaccaccattgatcgaaacttgtacatgtaaaacgtttggtggtttaatccaactcgcttgtgtttatagaaaattgggcccttatcgctgccaaagaaatacgttacagcaacaatcaaaaagataggcgacaatacaatcagtgcaaacagcgacactgagatgtccaaaaacctttttgaaaaggcatagctcttactatattttgtcatttttatcttcacttcatttatttgttatcaattcagtatagcaaaaaaagccactaaaaatgaacctttcctgagccacttttactaaaatgacgttttaagaagtgatatcccttatccagccagtttgttttttcagtcgtcacaagtgagtactctttagtgcgcttatcattggcaataatccagacatttaacaagcgctccgccatgaagcccagcgacctaacgtcttggccttctagtttagcccaatcgagtcgttcttcgactttccctaatacgtcaaacaaaaaatctgtatatgcttgaaaatctgcttggcgcatgattgccatgttaaacaaaaatgccgtctttgattgtgcaacttgttcgaacgcatcagtatatgccgtgaactccgaagcaatgacttccttcaaaataaagtaaggttcattggcgtgagcattcaaatagtgttgttcttgtgtttcgacgtagtaattacgtgctttaggcacaaggacatctgcctcctttagtcccgcattaatgtcgctctcggtcagaatgtcgtttaaatcatgagaacggcgcttacctaaataacgacggtaatgcgctaaaccaataacatcttcttgctgcaaattgtactttgcccaatacaatgccgttagctcattataaatcggatttttagcagagatattctgaccagtgttatctgcctggaatccaaataagtcgcttgctaactcgctccctacccgaattggttgataaatgggattattgggtattttataatctttgtgtgtcgcaattaaaattttcatcagcgtacctttttatttaaaaagccacggtctggaattgcccaagccgtggctacttttttacaaatatttcttgtcgaactcaggatcttgagatgtcaaaatctttggaccatcatttgtaatggcaatggtgtgttcgtattgtgcagaaactgaaccatccatggtcgtaactgtccaaccatcttcttcagacgtttcaacttcccagccgcccatgttaaccattggctcaatggtaattgtcatacctggcttcaagcgcaatccgtgccccgccttaccatagtgaggcacagcaggttcttcgtgcatcgttggttggataccgtggccaatgtactcacgaacgtttccgaaaccattctcgtcttcgacgtacttgttgattgctgcaccgatatcaccgatacggttaccaacttgcgcctgctcgataccaatgtacaaagccttaaacgttacatccatcagcttttggacttctggtgaaacttcaccaactgcatatgaccaagctgagtctgagtaataaccatccaagtcaacaacagtgtcgacctttaccaagtcaccatccttcaaaatcaactctttacgtggaaatgcgtgggcgacttcatcattaactgaaacagtcgttgcaaattcaaagccttcaaaaccgatttgcgctgcacggccaccgtgatcttcgatgtacttacgaccgaattcttcaatttcccaagttgaaatacctggcttgatgatgttacgaagttccttgtgcataccagcaatgattgcacctgacttacgcataccttcaatttcacgttctgacttaatcgtaatcaacgtctttgtccttctttcaaataagctagtatttgtcctgcgtctaacaaactgaaaaaacgcttaacctgtactattaactttaaatattgtaccacatcatacttgactggcactgtattttcaccacaccttgtcacccgtcgccttaccaccgtataattaaccagttgctattactatcaggagaattgactactatgaaaaaagtattactttggatattaggaatcgccttagccggtatcgttattatcggtggcgtggcggcctacaagatccataatacgacatctaagatttactcaaacaacgagcaaatttcaaaaacgtcagatcagaaaactagcgctaagaagccggttgcctacctattgcttgggacggacactggcgcacttggccgtgattacaagggacgtaccgacaccatgatggtgatgatcattaatccatcaacgaaatcatcaaccatgctgtcactccaacgtgatactttgatttcattgaatggtcaaaatgccaagttgaatgctgcttatgcatacggatcagccgattctgctatggccgaagttgaacaactgctcgacattaagctggacggttacctattggttaacatgaaaggtatgaagcaattggttaatgctgttggtggcgtaaccgttacctcacctttgacgtttaactatgaaggctacagcttcgtcgaaggtcaaagctaccacgttgatggtaccgaagcgcttgccttctcacggatgcgttatgctgaccctcgtggtgattatggtcgtcaagaacgtcaacaattggtcatcaaggctgtgatggacaagttgcaagctaacccaacgacggttatgtcagacaaattccttggcgcagttgctgataatgtccgtactgatgtgtcacttacatcacttaagaacttggctcaaaattatcgtgaagccggcaccaacattaagtctgaccaaatggtcggtaccggtacgatgattgatggtgtgtcataccaaattatggataactctgaaattagccgtgtccacaacgtaattgaaaacgcacttaagacaaagtagacgcaaaatggcgggtccgaaatattaatcggacccgccatttttagttttcgaattctttcttagctctgaaaataaccaacttactcaaaacgtaattcgttacaattacgaagacgttttgaataatattccaaagcatgtcgttttggtgcaaccagttaactccgataatcataatacctgatccgattaaaccagttgcgaaacgcgccacatagaacttgacgatttcatcgaagtactcacgtggcgtgctagcttgactgttaaagacccacctgcggtttgttaggtatgcggccaagacggtgataaaccaggccaaccagtatgacacttgcactggcatatctgtcatacgcaacaaggcatacacaacaatattaataacagtcgttaagacaccaaagaataagtacaaaatttgagagcggaacttgaccagcaagtccttaatcatttcgaccatgaagacatctactttctttttattcgctcaaattattctatcacacagtaccaagcctagctgttcacaatttgacgacggtcaccctgcatcatgacgcgttctaattgttcaaccagtgctggcacaatcactgatgtacgacgacgaacataagctagtagcaacgtgcatgcttctaatgtcacacgtgggttcaaaccagtgactgttttaattttgtctaatcgatattggatagtacggcgatggacgtgaagtgcgtcactcaaagagcacattgattgtccgaacgtcgcgtaaagccataacgttaacattacttcatcatccaaatgatcatgaatcaattgctccgtttctggatatgcgatccctgcatcaataatattggccaaatccatcatgttttcgtagtacatagtccgcatctcatcaaccatcggatgagtcatcgccagtgcaaaaatgccctctttcacactttcttgaacaccatgatgcggcatccccaccccagcaagcgcacgtttgggaagtcttggcacgaactggtcgacctcactcgtccgcaacacgtacacgcgtcgcaaataatccaattcaaatgccagacgctcatctggtagtttctgcttatcaccttcgacaacaatcgctacatactttgcgtcgaagtcaacaccgtatgcgcgtgccttattcataaacgacttatctgtgatgatgtcgttttctgataaatccaaccagttttgcataaatgtctgaagcatcttgagccctccctaaattcgcgaaattcttcattcctacttctttagtatatcagtatatcgcatatcggacatcaaattaatctcacaaattgtctgggtcatacacgataatcccgtgttcgcgaagtaaatcattgctgacgcaattgtaattataggtcacagcctcgcctgttatttcacgtaacgtggcaatcaaatcagttcgcaatcaagcgttaccgcaccgtgctcttatgctagatttacgggcagatttttctctgccctgtatactaatagcagaggagcattttttatatgattcgatattcaccagaatttaagcaatctcttgtcgagatgcacaaccaagggcgttctttgggttttgaaaatttttcggtgtagcggcaccttgcggtgtcgaaaaaacctgtccataatcttgacagcagcgccgaggttgatgagtgatgaatatacctattgtttctaataactttttagaagagtttgatacgaattttgataccgacatgcttgatttatacaagctgcaaaacacgttagaaattcaaaatgtcatgaataaagaaggaaatgttttccgaacaaaaaaagagtatgagaagcatgagttgctgttgccagaaactagcgagtatgacaacgcgtatgaaaacattgtgagtttacactcgcagttaagaaatttaacgcccgtagaagcgacagatcctcgaatttgggttgctttggaaaatactgattttttggattatcatttgcgcgtgttgaaggtgatggattttaaagctggaaaacaagaatcttcaattaagagccgctcaagttttattgtgaacggacataaaagatcgttagcgataaataacttagcttcactatggtggatagggcatgttttttatgatccagaacatgaagatccgtatcattttgttaagctttttacacaaactgattttagagggaattttgttgcgctttcgtcaagtaatgtaattgatagtgatcacatacgattgggtatatttgatgctgtgtttgagctgattcaagatggaaaaatttctcagaacagaaaggcattttctgaagctaataagattatgaatatgattggcgggattagattgttggatcttctatcacgtaaagaagtgtatgagtacgtattaaaaagcttgcctacccagcttgagtctaagaggagatgattaaatggcggaacaattcttacaatcattaacggtaactctaaaacagtatctgtctttggataccggtcagtatatgatcccattttctcaaagaccatacgaatggacagaggtgcaggttgaacgattatttagggatctcacatcgcttggattaccaggagcatatgaaacgaaacacgtattgaatttcttcacattctcaaatgaagaagaaaagctaaaactgtttgacgggcagcaacgtacagtgacgacgctgatgatctatgctgaaggattaagactatctgtcgaacgcggagaacttaatgttaaatttgcatcgaaaaagtatcaaaactatatcagtgacgaagatgaaaatggaaccgttacaccaaaagtggtgttcgataaaggtgaggttactgatgagttttataagctaattgactttgaaaatgactatctagtaaaagaacatgaaggtctcgatttgtcgatcaggtcatttataagaaataggctgaaaattcaacagttgtggcgtgaaatagtttcggatgatcccgacgttgtagtgaaagagatactgagccgatttttagagtcgacctatttaattgaaattatcgctacaacagaagaagtagcacaaagaatgtttgagacacttaataacacgggtaaaacgttagaatcatattatgtgttgaaaaacgatttagtatcaaaactgggcgaatcggtagtaagagaaaaatggaataaattggatgacctattaggtgacttagatcgcagaacattcttaagtactgtggccacgctgtttgctggaaaaatagacaaacaaaatgtgttagagtcaatctatacttcgtacgagggcggcatatcgataggactgttggatgcgctattggaaatagcagttgcatacgataaagcaataaatccaaaccagatggaaatatcaaatgtcatagagcgagatgagtataattacaccattgattctttgagagatgtgtttggactaaagcaacaaacgccaatgctgactgcgatgatccttagcaattactctacttctgatgaaatagcggtcttaaagaaagtaaaaagtttggcggtacggctattgttctttaaggaaggtcgtgcaaatagttttgaaaatccgttggctgaaatggcacacgccgtgtatgaagataaaattccagtgaaagaaatttttaataaactgcaagaaggtggattaaatatttcggatgatagtttacgcagtgtaattgtggatagagaaataacgacaccttctgcaagaaaaaaagctaaatttgtgtttaaagagctttacaatcaagagttggcaaaaaaatcaatcggaaactatgctgcctaacaatcttcagaagatacattacgagcatatcttgcctgaaaatccaaagtcgggtagtgagtggatgaaagattttccagatgacaccacgcgtgaacacttaacaaaaactttggggaatgcgacgttgcttattggatctaagaatgaaaaattaggaaataaagaattctcagataaacgcgaaatatataagacgagctctttgatcgaaaatagaagacttgccgagaataagcgatggactactaaagaaataaagaagcgttcagtacttttggctgagcaattcgtaaaattgtacaagtaaactttgatcatttattgcagcgaatcaatttgattcgctgtttttttctaaataaaatgtacaccatgttaaatgtctattggggtgttatattaatggtgttaacatttttgtttggggagaattaaaaatgaaagtatatctagtcgcgcagaatgctagtcatgatattgaaaacgagtataactttttgtggtcaccgaagttaaccaaatcgggtggacgcaacctgggatatgaaaatatgaagcaagtcagaaaaggggatgtgattttgcactcgtttgatcaggcgataaaggggataagcgttgctgtagacgatgtttactctgctgaccgacctgattttttaggatttgattctgatgggaaatgggatcctgatggttggcgcgtggatgtatcgatgattccggttgatttttcactacgaaacgaccgagattattatggtagggatgaaagccaagtgtttcaaaagaacggccagttaaatcaaaggtatctaagtgtagttggggatgccttgcttgattttttcaagcaaaaaattccccagttaaaacgtgttttggataatcaggaagtggaagaaagagggtcatggcaggaactgaaggacactgatttctcgttaaatgaacaagcggactttgatatagatgaattatccgctgataatttacctgattataataatgatgctaaagcgatcattgggtttattggtgaacaggcagcagtgaaatatttaaagtcaaaatatcctgatgcaaaggtaaaagggtgctcgctaaatcttgatagtaaaaacggtaatgattctttaggatatgacattgaggttaagtttaataaccaagagaagtggtttgttgatgtaaagactactacaggaaagtctgatatgttctatctatctgaaaatgaatatcaaactgctttgaacctagaaaatgaagcgaagaaaaactactttattctgcgaatttcaaaattaaacaaagataacctttcaggggatgtccaaaaattaagtgtgaatgacttgagactagaagtaaattcttacagggcgtttattaagtaattaaagtgtttccacttactttccaccattgaccaccccggtcgccttctgtatactgcggtatcaagaaaactaactcggggtagctagcatggcttttaagattgccgtatttggggtgcgcgacaatgaggtgccgtacttccatgacttaaacaagtacaactatgacctaacgttggtgacggagaatttgtctttggccaacgtggataaggtagacgggcatgatgctgtgttggcgcgtgcaaactgcgccttgcaggctgacatgttgcaaaagctgtcagaacatggcattaagtatgtcttcacacgaacggttgggcacaatcacattgatttgcatgttgccaaggaatacggcattacagtggcttacgtgcctagctactcaccatatgcggtggctgagttggcatttacgctagctttgatgcaacaacgtcaaacaaccttagctgttgcgaatgcagccaaaggacaattccaagtgctaccacaaatgtttgcgacggaactacatgacttaacggttggtattattggtactggccgtatcggacaagccgaagcagaattgtggcgtggggttggcgcaacggtacttggttatgatgtttatcaaaacgacaaggccaaggagctactaacatatgtgtctgagaatgagctgttagcgaagtccgacattgtctcacttcacgtgccacattttccaggcaagaacgatgcctactttgacgcatcatacgttgcgaagatgaaggacggggctgtgttggtcaatacggcgcgcgcagaaatcacagatcaagatgcgattctggctggcgttgaagttgggaagttacgtggctttgcgactgacgtgattgctgatgagcgtcacttctttggtaagaacttccaaggtgaatcgactggtaatgcgacggttgataagatgatggccttgtatccgcaagtcattgtgacaccacacatggggtcatacacagaagaagcgttgatggacatgattgccatcagctttgagaactttaacgacgtcctaacgacggggacgtcacgtaatttagttgaagtttaataatgatcgaaagcaggttccgttttggaacctgtttttactttttgttcgttttaatcatgatttagctatgttaatatagacgaaacgaattaaaagacgaacgttgtttattaaggggagaatgaaatgactgaaaaagtgtactttagccatgatggtggtgttgatgatttggcatctttgttgatgttgttgtcatacgaggaacaaggcctaattgaactagttggtgtaggggttgtgccggctgattcatacttggagcctgctgttacagcaacgcgcaagattatcaaccgtttctcaacgcaccacgacttgttggtgagtgcatctgatgcaaagtcgagtgatccatttccaaaggagtggcgcatggattcattcacggttgatgcattgccaatcttgaatgaatttggtgaaggggacactgagttgtcatacaacactgcggccgatgacttggcctcaatcttggcggaagcgacagaaccaatcacgttggtcttcaccggtccagtgagtgacctgggagctgtcctacaacgtgacccaagtttgtcagcgaagatcgaccgcctggttgtgatggctggtacgtttggcgttggaaacatcgctgaacctgagcaagacggtacggccgaatggaacgtattctgggacccacaagctttcaagattgtctttgattcagacatcaaaattcaaatggttgggttggagagtacccacgaagtaccgttgacgccagctgaccgtttgcgttgggcgaagttgcgttcacacccagtgatggacttcgtcggccaagcatacgcaacggtgccagtattgacacacttcgagacgaactcaacgtacttcttgtgggacgtgttgacgacagcctatgcacaaaagccggagttggtggaaacgaagatgatgaacgtcgacgtaattccaactggccagagccgtggccgtacgttcgaaacgccagagggacgcgaaattgaatttgtgtaccacgttaaccacgacgctttcttcacgttctttgaagagacgatgatggcaatgaagcattattaaacaccaaaccactgaatcaaaccgattcggtggtttttaagtgcttattttttaccattgtaaaccgctatctaaaaggctacactagacttaaattagaaaaaggtgaaaatgatatgagtgaaatcacacaagaacaattagcgtatttcaaagaagcagtggcggttagtccaaaggctgatgcgctacgcaatgcggtaacgacgaacggtattttgcaagcagcgcgcgataaccgtcgcgctggtgaattgacgcctgtctttagcgttgacctagaaagctcaccagttgcgaaccaattacaatctggtcgttgctggatgttcgccgcattgaacacgatgcgtcacgatatgaaggcattgtacggtttgcctggggacttcgagttgtcacaaagctatacgttcttctgggacaagttggagaaagcaaactacttctacaacaacatcgtggctacggctgagcaaccaacgactgatcgtgaagtcgccttcctgttacaaatgccacagcaagatggtggccaatgggacatgatggtcggtttgattgaaaagtacggtgtcgtgccacaatctgcttacccagaatcacaagcatcatcacactcagctgacttcaaccgtttgtacaatgcgaagttgcgtaaggatgccatcacgttgcgtcgcatggtgacggagcatgcaaccgaagagcaaatcgcgcaacaagttgcccaatttggtcgtgagaactaccacatcttgtcattgacgttcggtgagccaccagtaacgttcaacttctcataccgtgacaaggacaataacttccacagcgatgctaacatttcaccaaaggatttctatgcaaagtacattggttgggatttgagtgaatacgtttcaatcattaacgccccaacagctgacaagccattcaaccaaacttacggtgtgaagatgcttggttcagtggttggcggacgcgaagtaaagcacttgaatttggacttggcaacgttcaaggacttggcggttaagcaattgttggctggtgaaaacgtttggttcggtgtcgacatgggacctaagttggaccgcacggctggtttgatggatacgaagttgtacaacgaagatgatttgtttgatgtcgacttcagcatgacgaaggctgaacgcttggagtttggtgattcattgatgacccacgccatggttttgacgagtgttgatttggttgatggcaagccaacgaagtggaaggtcgaaaactcatggggtgacaagaacggtcacaagggttacttcacgatgtcagacgagtggttcgacgaattcacataccaagttgtgatcaagaaggagcacttgccagctgagttgcgtgatatttacgagaacacaacgccatacgaattggcaccatgggatccaatgggtgccttggcataatagattgtttaggaacggtgcctgtagtgggtgccgtttttatttgctaatgatttcaaaaccaaaacgaagcgccgattttgtattcgtcctattatgaaatgaagagaatacagaagagggagcagtatggaacgcgtctttttaaatattaaccagacgaatcgagaattaaatcgcaaaattaagcagtatctcaagcaacaaacggtccgtgggcaggtccgtgatttacgtgtgttggcccgtgcgttgaccgatgtgacattgttagtgccggttacagtgagcgatagtgaccgacgaacatcgtcatcagggtatacgtatgtgattggcacccctgatgtgcaacgacaacagggttatacagtacgtgatgacggccgctacttggtgctgtatacggatttggctaaaagtcgcgcagggcatcgtgaacccaatacgatgcaagttcagatgccgtttgttttgcagaaattgggcaatgccaaaaatttggccggcattattttgaatccaggtacggatgatgttgttttgccaaaagcattgttggcagaagagttagacggtagtgacacgggtgccgtaactgggaccgtagcggatgacctaccaattcaagccccagaacaagtggcaccaccaattggtgtcgtagcagttgggttacgtttgaatgagttgagtcgcttgaacgaagaactggaaacgttccgttcgaagactgaacgccgcattgatcgatatgcgcgtcagacatggaactttgtcgcagtcgttgtgttagtaactttggccttgctggctgttccagcattggggaggcgtggcttattgccaacagtcattttgattgtgctggctttgattgtggggcgcattatacccgtcagcgcaacaacccgacaaaaagcaaaaacacgcgtatacgaaaaagaacgcgcattggtgcggatgattgcgctagaagatgaaattgcacgtttatcattcaatacggatgataatcagcaactagatgatgcagctgattatggcaccgatgacttggattacattaatcaggatgtgcgcaacacaaacttggtgcgactgctgggttacttcagcgccgcaactgagccagatgaaaaggaatatctgctgggtgagattgataagcagttgaaaaaagccttgtttgtgcaaccaatattttctgaggggcacgtcattgaacgagatgttctaggccggccatatttagctgacgatgaaccttggattaacgagtttatcggtgatggtgaaggtaatttgtatttgcatctgtacttaaaaaccagagatgcaattaaagctgatcgggaaattttgacgatacgtcgtgctgattggatttcgtatatgatgaacgtcaacccacaattggtgggggttgcatttgaaattcctggcgaaacggttgtatttgatcgcgaagatttatcgcagctacattacgagccaaactacaatcgtaaggtgccaacatcgtacttcatgcctggtgaccttgatgcagttaagaaacctgagcaaaagccacaaccgaaagctggttggtttgcgaatgtagccaggtcagatattgattggtcaggctatgctttagcaatgttgattgcgtacgcgattggctggtggctgatgtacagtaataaattccaagacggcctaaaagtagtgatggtggcactggggttgggtctggtcttcttcttatttacattggacattaaccgttatcgaaagaaatacaacattaccgatagaatcgcacagaaaaatgacggatggcgtcatatgttggggtggtttaccggggcgatatacattgcaccgattgcttatgtgtggcagccaacctttgatatgctacagatttacatggtcttgctgggatcatcagcgtttatggctgcgattttgattgttgtcggactatctgaggcgcagaataacaacaaatagtcgaacgaaacatcttggtgaaacactgagatgttttattttttgccattccataaaatattcgagatttacaaatccgtttgtctaacgttagactgagcttgttaaataaatcatgaataaatcttcggggcagggtgaaattcccgaccgacggtgatggcgtatgcctcagtccgtgacccgcaaagctagtttagcgatgcggttgatgcagtgtgaatctgcaaccgacagtaaagtctggatgggagaagatatcaatctttgtattagtgcacacttttttcagtggcctagtacgctttttgcgatacctcaaacaataactacgctccggcatgatggtcaccatcatgccggttttttattcccggagtagttaggggaagatatggatgatttaacaatgatgcaattggcggtggcagaagctgaaaaagccgcacccaaggagacatggactaacccgcgggttggcgcggtgattgtcaaaaatggtgtggtgttagcgacgggctatcatcaccaattcggccaggcgcatgcggaagtggatgccatgcagcaggtgcccaactcagctgatttaaaggacgccacaatgtacgtcacgctcgagccttgtgcccatattggtaaagttggcgcgtgcgccgatgcgattgtggcagctgggattggtcgggttgtggttggccaaggtgacccgaatccgttggtacatggacaagggattagcaagttgcgagatgctgggattgccgttgatgtgttaaaccaatcggtcagtgaaaaattgaatcctagttttcatcacttttttgaaactggtcatccgtacgtcatgttgaaagtggcgcagagtgctgatggatatattactaaggtagttgggcaatcaacgaaaattacagatgccagtgctgatgttgcaacccatgaacaacgcgctcaggttggtgcgattatcgtcggtagtgaaacggcattaactgacacgcccagtttgacggtgcgacatacatcgatgacacatccccagccattacgtgtgattcttgaccgacgtggacggctgcaaagtgaatcccaattcttcgatgatcgcacgctgatttacaccatgaatgaggcgtttgcgggagccaccgaacaggctattttatttgatggccgtctgcagtcgatgctggatgacctcggccacagaggtgtgcaatcggtactagtggaaggcggcggcgctgtgctacgggcgttcctagccacggatttgtggcaacagttggatatttaccaaacaacaacggtctttggaacgggagtggctggtattcaggtgccaacaattagcgcgagcgtctcagagcgtatcggtaacacgatgcatcatatttattaccgggagagaaaataatgtttacagggattgtatcaaccgttgggcaagtgactgagcttgcaaaacgacatgaacaagagcgccgtctgacggttacgacgccaacaaattattttgcagatgccaagttaggcgacagcatcatgattgacggggtgtgcttaacgattaccacgaagacggcgacagaggcgacgtttgatgtgatggtgccaaccgtgatgacgacgaaaataggtcagtatcaacctggaacccgcgtcaatttggaaaaggccatgctggccactgatcggtttgatggtcactttgttttaggacatgtggatggaacgggacaggtgaccgacgttcacatgatcgacgaaacggtctactttacagtgcagccccagcaccaagccttgatgcaacaaattgtgccgaaggggtcgattgcaatgaacggcgtgagcctgacggtgattgaaacaacagccacgacgttcacggtgggactgattccgcatacattgacgcatacgatgttgcaggatgtgcaagttggggatgacgttaatttagagactgacattctggccaagtatttagcaaaggagcgtggataagatgaatcaggaaattcgagtacgcgtagaagcggcactgcaagcgttgaagcgtggcgagcttattattctgagtgatgatagtcaacgtgaacatgaaggtgacttggttggcctggcttcgtttgcgacaactcaaagtgtgaacgatgcgttgcggattggtcgcggtgtgttgtgtgcaccaatggccactgaacgtgcagaagcactggccttatctcaaatggttgcgcataatactgaaaagtttggtaccaagtttacggttagtgttgatcatcgtgagaataccactggggtatcggcagtggaacgcgcgtttaccattcgggagctagccaatatgtctgcgaaggcaaccgattttgatcgacctgggcatattttcccattagtcgctgaagctgacggtgtgttggcacgaccaggtcacacagaagcagcggttgatttagcaaagctggctggtgtaacaccggtggcttacattatcgagattttggcagatgatgggcaaatggcacgcgaaacagcgttgactgagattgctgaacgtgaagggttagtcacgttaacaattgcggagttaatcgcgtatcgtgaggcgcaaatggcgcgtgattacgcggtgggtcctaccattaaattaccaagtgcatatgggacgtttgcggtgacggattatctgtcggataatcgtgaaccagatttgttggttgaaaaagcgacgactgatggcgcggtgccattggttcgattgcattcagagtgtctgactggtgaagtgcttggttcattccgatgtgagtgtggaccgcagctccacgaggccttgcgtcaaattgatgctcaaggtggggcagtggtttatctgcgtcaagaaggtcgtggtatcggactagccgaaaagctccgtacctacgtgttgcaagaaaatggctacgatacgtaccaagctaatgttcacttgggtcaccaacctgatgaacgcgactacgcgcatgccgcccaaattctgaaggacgccggctatgataaagtccgtttgttgacgaataatccagccaaaattgcccaactcgaggcccatggcattgaagttgtcgaacgggtgccgctcattacgggtgtgaataacgtgaatcaagggtacatggacacaaagcgcgataagtttgcgcacatgatttaaaaggggaataacatgacaatttatgcaggaacattaaccaaccatgaggaacgacacattgcaattgtgatgagccgtttcaatacactgattacggatgctttactggcaggagcaaaagaggcgttactgatgcatggtgtcgtagagaccaatattgatgtttattacgtgccgggtgcgtttgaaattccggtggtggctgaaaaggtagctttgacgcaaaagtatgacggcattgtcaccttgggtgcggtgatccgtggcgagactgatcactacgatttggtgattaatgggtcgatgaacgggattgcgcaagttgggttgaagactggcgtaccaaccgtattcggtgtgttgacagcggatactttggagcaagcccaacaccgtgccggtggaaaagccggtaacaagggtagcgaagttgctaccgcattgctcgaattgttgagtgtggtggatgtcatttaacggctaattatgacctaaaatcgaacaattcagaatccaagtgctcatgttaaaaatcttcatatttgatacgtaccatcctaagtaatcaaagaaaaataatagtgaggtattacttatcatggtagatcgtttgaagggcaaggttgctatcgttactggtgggacaactggtttgggaaaggctattgcacaacgctttattgatgaaggcgcaaaggttgtcatcacaggacgtcgtgcaaacgtcggtgaagcaacggctgctgaacttggtggggatgatgtgattcgtttccaacaacatgactcagctgatgagcaaggttggaaggacttgattgcttatactgaagaagcgtttggaccactaaatgtgttggtaaacaacgccggaattggtgcaacgaatgatattgagcacgacacgttcgaagcttaccgtaagttgatgagtatcaacgctgacggtatgtacttgggtacgcaatacggcttccgtgccatgaaggagcacggtggtggatcaatcatcaacatgtcatcaatccttggtttggttggtgatacgatgacggcttcatacaacgcatcaaatggtgctgttcgtttgttctcaaagtcagccgctgtttatgcagcgcaaaacgacttgaacattcgtgttaacacagtgcaccctggttacatcgcaacgccaatgactgatggatcaggtgagggtgactcagttgcaccatacgttacgcaacgtttgaagacaccaatgggacgcatgggtgagcctgatgacatcgcttggatctgcgtatacttggcatcagacgagtcaaagttcgccactggtgcagagttcgtcatcgacggtggatacacagctcaataattttatgacgaaagaacccgcaaattcggttgtgaatttgcgggttctttttggcatgctacagctgtttcagttgttcaattagaacatcagctttactctcgcttaacactctaaaagcaaccgactcactcatgatgagttcagtgatgagatggcctcgtaaggcgccacggatagccaatgattttgatttgtcttgtgctaacgcgacacgccttggtacagacataatttcttctagtgataatccaacgattttgtcattctggatattgagtatattgccgttttcgtcgtaagggcgaccgtatatataaccagcaatatcttcgcgacgtgtagttgggaaaatgctatgccagttattattccagataggtattgaatcaagcgaagctggcgtcccgagcgcagtgactaaaaaatccatattgcgcgcaacggtgagcgctcgctgcatagaaggctcggcatataatcccttgcgaacgaggtcgttcaaaatgtacaagggagcaggcaacgtaaaaaattcgccggaaaacttacgcgatagtcgttcgacaatatgcgtagaatcagccgctgaattgtattttaaattttcacctaagaattggacaaatttgacgttttccaatgtggcagttggggcatattcaatcatggcattaatggtttcgccccacgaaataccaactgttttgttgccacctttaatgtctgcgcttaatttttcggcagcgtaaagggtaacgcgttcggaagtgccaatcacgttttcatcatcttggataacgaaaaagtgtgtccctggatactgttctgatagcaagcgttcaagacgggaattacgttggtttgaatttctaatttcaatttttataacgccatctttcacagcttgatctaaagctttgttgattttgtaacggctgattttatacttatccgaaatgtcgccaaaggttaatttattcagataataatcttcggcaattctagctagttgttcttcatccattgttgttttcctttgaatgtgaatgttgtaacatcatcatacacctttttaaaaatttgaactagtctacaaaaaattgaatctattttaaaaaattcaattgaaaaagcgtaagtgcattttaaaaatttcaaaaaactgcgagatttaaagtagaaattcgcagtttttttattttgtctatttacgcctgtttatcgccaacatatactcatacacgtaatcttatgtgaattgttgaacatagaaggaggcaaaatattgtggttgatatgaatcgtgttttgaagatgcacaaagcccacactggtgtattggatcttaaagccgatattagtattaaaacaccagatgatttaagtgaagcatacaccccaggtgttgcagggctcgccaagatgattgcggaggacgaagcgttgaaaaacgtttatacgatgagtgggaagttgattccaatcatcactgatggttctgcagtacttggattgggaaatattggaccggcggctgggttaccaatcgttgaaggaaaggcacttatttacaaagagttttcaggtgtaaatgccattccgatggcgttaaatcaagtggacgtcgatgagtttgtcgaaactattaagacaatggcgccgtcatttgcaggaattcatttggaagatatcgcggctccgcgcgtatttgaaattgaaaagcgattgaatgaagaactggacatccccgtttatcacgatgatcaaaccggaacggcagttgtcgtcttagcagcacttatcaatgcagccaaagttgttaacaagcctttgaaagacttgaaggtagtgattaatggtatgggagcagctggagtggcaactgccaaaatcttgttagcgagtggcatgaagaacttgactctagttgatattcacggtgttatccgcgcggacgataatgactacaacgagtatcaacgcgaactagcaacagcagttaaccaagttgacggtcaaagtttggatgatgtcatcgataatcaagatgttttcatcggattgtcagacgcgaatgttttgtctaaggaacaagttgcccgtatggctcaagatgcgattgtctttgctctggcgaacccggttcctgaaattttgccagaagaagcgcatgaaggtggcgctgcgattacggcaactggctcatcacaatgggcaaaccaagttaacaatgtgttggtgttcccaggattgttcaagggattgttagcaacggacattaagaaggtggaactacgtctgcaagttaaattggcggaagggttagcacaaatgataactacgccaacggcagaccacattgtgccacgcgtatttgatgatggtgtcgtcgatgccgtttcaaatgcagtaattgcatacgctaaggcataacacagacataatatgactgatgaattaagagatctctatctattgaataaacaacaacgacgcacttggcaacggtttgtgaccgagcgaggcatccccaactttaacgccaatgaaattgatgtcattgaagaaacggttggccttttcaatgatgaagatgagctggtaggaacagggtcgataacaaatcacgttatcaaatatgttgctgtttgtgacaaaggcaccgattcgaaaggtgctcgttttaatcggattatttcagaactagaaggacgcctaattagaaaaggtcaaagccattatttcgtatttacgaagccagaatatgtcgctagcttcagttacgtagggtttaagcctttggcgacttctgagtacggtgcattgcttgaaaaaggaacgccaaatatccaaacgtttgtagaaaacgtaccacattatggtgggactaaagcggcgattgtcatgaatgcaaacccattcacgttgggacatagatacttagtcgagcaagcaagtagagaaaatgatcatgtttatatctttgttgtaaatcaggacgtatcgctgtttacgacagctgagcgtttcaatttggttaaacaaggtgtcgcagatttagataacgtcgacgtgattaacggtcaagagtacatggtgagttatctaagctttccgtcttacttcattaagaatgcagacgatgtgattaagtatcaaacaaccttggatgcgcgtctgttcagggatggcatagcaaaaccgcttaacatcacgaaacgatacgttgggacagagcctttgtcacatacaacagccatttacaatgaaacgttgcaaaccgagctgcaaccaagcgttcagttgatagaaatcgatagaaaacaatttgaaatgacgcgtgttatttcagcaacaacagtacgttcagcaatcgaacgaggggacgaaatgctttatcaacaattggtgccaccaacgaccaaacagtttattgataagcatttgggcctgttgcaggagcgtattgaaggaggaaaaaaggttaatggaaattaagaaaagtgcagtcgccggcacactagaatcatccgacgtacaaattatgttgagtgctggaaataacggcatcgaatttgagctggtttccgatgttgcaaagcagtttggtgatgcaatcaaggaaacaattactgatgtattgaacacttatggcgtaacggatgctgcagttagtgttgtagataagggagcgctcgatatggtgattcgtgcacgagcaatcgctgttgtacaacgagcactcgatattgtagatacgccaaactgggaggtgctttaagatggctaatactgaggaacgtttacgtcgaacaatgatgtttgtgcctggaaacaacccggcaatgatcaaggatgctggtatctacggtgcagattcaatcatgtttgacttggaagatgcggtgtctatgcctgaaaaggatgcggcacgctacctagtatacgaagcgcttaagacggttgactatggtgatgctgaattggttgttcgtattaacggcttggacacgccatatttcgaaaatgatattaaggcgatggtcaaggctggggtggacgttattcgtttaccaaaagtggaatcagcagagatgattcataccctggaagagttggttgaaaatgccgaaaaagagtttggacgcacagttggtgagacaaatttgatggcggcgatcgagtcagcaaagggtgttgttaatgcttacgaaattgcaagcgcttctgatcgcatgattggaattgcattgtctgctgaggactacacaacggacatgaagacgcaccgttatcctgatggtcaagaattgttgtacgcccgcaatgtgattttgcatgcagcccgtgcagccggtattgcagcttttgacactgtgtttacgaacatggatgacgaagaaggatttaagcgtgagacggaattgattcaccaacttggatttgatggcaagtctttgattaacccacgtcaaatcagttgggttaatgatgtttatcgtccaacgaagaaggaaattttgaatgcccaaaacgtgatggcagcaattgaagcagctaagcaaaagggttcaggtgttattgccatgaacggacaaatggttgatcgtcccgttgtgatgcgtgcagagcgtgttatgcgtttggctaaggcaaaccacttggtagatttggagggaaactacattgaagaatagtgtaaatcgcgagattccagacgaaattttgcaagataagaattataacgcatttgaaactgttgaattcggtcacccggttatcgatcgcgtggcgcctaaggttcgtgctaccacgggcgatgataagatgattgattcaattgatgaagttgtttcaaaaacagtctgcgatggcatgacgatttcattccaccaccacttccgcgagggtgactttgtattcaacatggtaatgcgcagcattattgaccacggcgttaaagatttgacgttggcaccatcatcactaacaaatgtgatgaacgatatcgtggttgaagcgattgaaaagggtgttgttacgaatatcacgtcatctggtatgcgtggtacgttgggggatgccgtctcacacggtgcgttgaagaacccagttattttccgttcacacggtaatcgcgcacgtgcaattgaggctggtgatatcaagattgacgttgccttccttggtgtaccaaatgccgatgaaatgggaaatgccaatggtatggatggcgatgctgccttcgggtcattgggttacgcccttatggatgcgcaatatgccgatacattggttttggttacggatacaatcaagccttatccaaacacacctgcatcaatcaagcaaacgcaagtcgattacgtcgtaaaggttgatgctgtgggtgatccagacaagattgggtctggtgcaacacgctttactaaggatcctaaagaattgcaaattgcacaaattgtgcacgacgtcattgtgaactcaccatacttcaagcctggtttctcattccaaacgggtactggtggagcggctctagctgttacgcgtttcttgcgtcaatcaatgattgaaaagaatgtgaaagcatcatttgcacttggtggtatcactaagccaacagttgacttgcttgaagaaggtttgattgaccgcgtaatggacgttcaggactttgacaagggtgccgcttcatcaatgaagggtaaccgtaatcaacaagaaattgacgcgtcatggtatgcagatccagctaataagggtgctgttgttgataacttggatgttgttatcttgtcagctttggaaattgatactaagttcaacgtcaatgttatgtctggttcagatggcattattcgtggtgctatcggtggacaccaagatgccgctactgctaagttgaccattatttcagcaccacttgttcgtggacgtattgcgacagtggtacctgatgtaacgacggttattacaccgggtgattctattgatgtgttggttactgaagtcggtattgccatcaaccctaagcgtcaagatttgattgatgttttgagtaaggtgccagggttgcctatttacaccatcgcagagttgcaacaaaaggcagctgcaatcgttggtacgccaaagccacttgagtttacggatcgcgtcgtagcgttggttgaataccgtgatggtagcttgattgatgtcatcaaggaaattaaagattaaatgacttttggaatgccatccaaaagggaaatgtgagttagataatgagtatttttgatataggtgaagcggttgatttgctgacggtacttgataaccgtgaatggcgcagtcgcttacaagagaagttgaaagtgaccaattctgacaaaattgttatcagtgcaaaattaaatatacctggttctatcaagaataacgatatcctacagaaagttttcatggacggatggcagacatttgttgcagggcttgaatgcaacagtcagtatgaaatgctgtttgctgagcgcgttacaggcccagaagcctttataacagtggatggtaatttagctaccgttaaaaagaccgctattttatttgaagaaacctacgccttaggaagactgtttgacattgatgtgatggctaatggtcaagctggttatcaattgtctcgtgaggatttaggctttggaccacggttatgcttgatttgtggcaagccagcaaaggtgtgcgccaaggagcaaaatcacacgcttgatgaagggtatgaagtgattaatcaaatgtaccaaggggcaaccagcaaagagttaatctttggaaaagagtcccaagaaactgtcgtaaataacgctctaaaaggattgctttatgaggtgtctttgaatcctaaacctggtttggttgatccggtttcaatgggttcacacactgatatgaatatgtttacgttcattgacagcagtctgtctttgaaaagttatttagacaaagccttcaagcttggtcgaaattttgagggaagcgatttgacgttgttgtttaacgctttaagagctgaaggtgtcctcgctgagcaaaccatgtttaacgcgactaataacgttaatacacacaaaggtgccattttttcgttaggaatttgggttactgcaattgcgtatgccacaaaagatggaacagcaacaatgacggaagttcgtcgtgtgatacaacgaatggttgaaggccttattgagaaggatttgtcttcgaacagagtggccacaacggcaggtgagcaacaattccaaacctatcaattgacgggtattcgaggagaagcagtcaatggttttccgggtgttgctgaagttgcagtaccgtttttgcaaacaacgtttggcacaatgacccaacggctattggatactttgatgaaaattgcagcgacacttgaagattcgaccttgatcaagcgcgccaaaacacctgatgttttggctgagatgaaagaatggacaagtatatatttcaagctaggtggtagtcacactgagcaaggtatgaaatacttgtacgatttggatcgattatttatcgaacgaaacttaagcattggcggttcggctgatacgctgattttgacgatatttattggtcaactaacggggctgctataaaatgcaatttttaacggatgatcatgtgaagctgatttatacggacgaaggtgatggacaaccaatcatttttttgaccgggtattccggcataaaagaagaatggtacttccagcgcaacttttatgtgaatcacggttatcgtgtcatcacagttgattggcgaaatcacggtgaatcggcccgaacgggtaaaaatctaacaattaaacaattggctgctgatgtgaacgcattaatcatgtacttgaagcttgataaagttatcttaattggacactcgatgggagcaagtgttatctgggcctatcaatcccagtatggtgaaacgcacatcgccataataatcacaattgatgaatctcctaaattaacaaatgattcggattggcaaagtggcgtgcgaaatttaaatgcccaaacgatggacttcgttttaccaaccatgatgaatcaacaaatgtgcatgcaaccaatcgattcaaaattaagacaactattagcacaacagcatgaaagtcatttctttgatgcaacattaaacgcgcctttgttggcgaatcatgcgctgtcagattggagacaaacgctcgcagatctttctatcccacaattaattgtgacgggagaacggtctccaatctggcagcatgatttttgtcgctattgtgaaaaaattatcaatgacgaatctcgggtcgtcaccattaatcaggttggtcacatgccacagatagaagtacctgaaaaatttaatgaaataacgttggattttattcaacacaaactaggaatataagacagatataaatggagatagaattatgatgaatcacgcgcattcaagtcatgtggggatgactaacgtgaaagaagaaattgggaagttcgatcgtattcgcattagcggaatcggattgattgcttacgcatttatggcagttttgttgattattgcgatttcaacaaggacgctgccaaatacaatgattggtgcaatttttgcattggttctaatgggacacgtgttttactaccttggtgctcacttgccaatcttccgctcatatttgggtggtggatcggttttcaccattttgttaacagccattttggttgcaacgaatgtgatgccaaaatatgttgttacgacagcttcaggatttattaatggcatggactttttgggtctttatatcgtttctttgattgcctcatctttgtttaaaatggatcgtaagatgttgttgaaggctgcagttcgattcttgccagtcgcattcatttcgatggcattgacggcggttgtaattggaattgttggtgttattattggtgtcggttttaactacgctattttgtacattgctatgccaatcatggctggtggagttggtgccggcattgtgccgctttctggtatctatgcacacgcgatgggcgttggatccgcaggaattttgtctaagctattcccgacggttatcctcggaaatctgctagcaattattagtgctggacttatctcacgtatcttcaaggacagtaagggaaatgggcacggtgaaattctacgtggtgaacgcgaagaagccgctgctgctgaggagattaagcctgattacatgcaactaggtgttggattgatcattgcggttatgttctttatgattggtacgatgttgaataaggtgttccctggcatcaacgcatatgcatttattattttgagtatcgttttgacaaaggcatttggtttgttgccaaagtactatgaagacagtgtaattatgttcggtcaagttatcgttaagaacatgacgcacgcattgcttgctggtgttggattgtctttgcttgatatgcacgttttgttggcagctttgtcatggcaatttgttgttttgtgcttggtaagtattgtcgcaatctcattgatcagtgcaacgcttggaaagttgtttggattatatccggttgaagctgctattacagcagggttggccaacaactcgatgggtggtactggaaacgttgccgtattggccgcatcagaacgcatgaacttgattgcgtttgcgcaaatgggtaatcgaatcggtggtgccttgattctggttgttgctggaattctagtcacattcatgaagtaatttagatatttgaagaaacacgaaaaagcgaggaaatcttaggagaaagattactcgctttttcagtgtctgaattcgattagttcacttgctaaatagctcttgaatatagttgcgttcgccacgaattaagcgcagtaggtcgataacgaaacggtgttcgtcgatttcgtaaatgatgatgtgctttccgcttacaatacgcatcgcattggtgtttaactcaggatgaaagttgcgcaatggaataccaagtcttgggctagtttccaagcgctcaatatctgcaattaaacgagccatgactcgttgtgtgacttcctctgaaaaattggaagacagatattcatgtatttcgtctagatcgttttgaaaggcgttagtgatgttaacttcgtactccccaggcatgtaatttcccccacaaattacttcaaataacgtttcttaatttcatccagtgtatgattgccaccttcggcttttgcctcggcaatcatatccaataatgaatcaacagccaccatttgctttgtctcgagattgggttggaatggcaacccattatcgtgaataacttggcgtaaaaagacgttgactgctgatgacaaatctaaccctaattcttctaggatctctgatgcttgttgtttaacttccgaattaatacgaatcgaaagtctatcagttgattgttctttcatatccatatgcctccatgtgtttaattgtacacacaatgggtgtacataacaatgtgtttcactcatagaactaaatgtgaataaaatcacatttacaaacttctaaaaaagaagtaaactaatttgtgtagaagtgagcaagagataataaatagaattaattgagaggtaaatatcatggctgatgttgcatttatcacaggagcaggacaaggaatcggtgaggcaatcgctaagcgtttggcagatgatggcttcaaggtggcggtagtgggccgcactttgtcaaaggtagaacgcgttgcgaatgagattaacgctgttcaccctgacgctgctttggcagtcgcagcggatgtagcaaagcgtgatgacgtatttgccggtgtacaaaagacagttgatcattttggggacctaacagttgtgatcaacaacgccggtgttgcaccaacaacgccaatcatggaagttgacgaagagacaatgcgctggacgtttgatacgaatatcaacggtacagtgtggggaacgcaagctgcggtggaagcctttaagaaggctggacacgggggtaagattatcaacgccacatcacaagccggtgtggaaggaaatccagatttgacggtttacggtgcatcaaagtttgctattcgtggtattacgcaaacgacggccaaggaattggcaccattgggcatcacggttaacgcctttgcacctggaatcgttaagacgccaatgatgtttgatattgcccacgaagttggtcaaaatgcaggtaaggatgacgattggggaatggcacaattctctgacggtatcgcattgggtcgcttgtcagaaccagaagaggtcgcatcagcggttgctttcttggctggtaaggattcaaactacatgacaggtcaaacgttggttgtcgacggaggaattgtgttccactaatagaacacttgttaaaactatcacattgaaaatggggcagttttagtctaaaatacaggtatcacgaacttatgaatagtaagttcggcgcgtggtttggcatctctcacaatataatactcacacacctatctcatataatcgcgatcgcctggagaggcggaccgccaaaccatgaataacaagaaacgctgttacggttcgtagcagcgtttttattatggtatagttgggtacatgatttttaagttttgggagatacagataccgagatgattgaagaagagtttgaacaagcggttgctaagttgaatgacaacttgaacttggcgaaggttgatgacatcttgaagccggttttgttggccggcatgaagcgtggttacgtggatgcgcacttggaaatattcgctgaagtagagaacatcaacccagaagagcaaacggcagaatgggttgaccgtgcggagaagtttgcattggacaactttggtacgttggacaaggttgctcgcaagaacagttctgatttgtatgcgcaaattaagagcatgttgtctgaagagtatcacgagattacgcaccacaaccacgacaagattggccaagccaatgtggtaatgccatacttcaacggttggttcttgggtgcgtactacgcctttattgcgttgttcacgcaaatgcaacaagcacaaggtgaggttggtccaactgaaacgcaagcaattgccaaggcagcatctgatcgtgccgagaaggaagtggaagtagaacgtcgcaagttcaacaaccgcccaatttaccgccaatcaatgttgcgcgaaatgatggcagctttataagcaaaaagaaaacgcatgacacaagcagatgcttgatgtcatgcgttttttctatggagccgaggggagttagataatgggccttacaaagcccggtatatcaacgtttgtcttttgaaaatagcgaaagggtcgcattttgggtcgcaaccgctagaaattcactagtgaagtgaacacatcagcggtcttatttttgacctcatcaggtagcgccgtataaatcgccaaagtcgtttttacatcatcatgcccaagctgatactgtaacgccttgatactcatattactttgtaccgctaacgttgcgtatgtgtgcctgaacccgtgtactttaattctaggtagcccagcggcatcagcaatctgtatcagccactttctaggggatgacacagccaagtgtgatacaaggtcgttgccagtaatcacaatgtttgaaccgcgacggcctgaactcattaaagcagcgctttgtttggcccgccaagttctaagtgtttgcgcggtcttttggtcgaaattgattacccgtttacttgccggtgtctttggtccgccgataacaacaccggttcccgacgactgactaagtgactttgtaattgaaatagtccgatcagttaagttaacatcatcccaagttagggctaacacctcaccgcgtcgcataccagtaaatgctaacaaccggcaaaatgccaccacctcaaagttcttagcagcgtacaagttgtttgccgcgtccatgaagcgttttagctggtcaacggtgtaatagtccaatctgtctgaataaaccggtacaggcttaccagcaggaaactcaaccacatcaaacgggttctttcgtatcatccccataattagagcaagtttcattgttgccctgaaagggtgcatagcctttttataatcagcccgcacaccggccatacggtttaagtagagttgcaaatcaacgggttttatcttatcaacatacacaccagcaaacgcatccgccgttaaaacgtgggtacgcataaagttgtctgtcttgtttgctgtcgattgtcgtacctttgttttgtaggcatcaaaccaagtctgatacaaatcatctaacgtcatgcgttcaggtatctcttcaaactcaccagcatcatcatccaccaaagtctgacgctcccaaatcttagccgctttactactcgtgaagccggcttttttcatataccgccgcttattggtctttgggtctcgtgaaatctcaacacgggccttatagaacgtgccccgcattgtttcatatttgctaacagtcattatctattcacctcataagtggccgcccgccggttatgtatggtgtgtgagttgttagctatgttgggtcgcccagatttgggtaacccttttgttttggccaaaagttataagtgttggataaggtggcggaattttccgctgacctaaatgggtgtcgccaaaattggccagaccccagattataagaacggtgtgtagggggttgcataaaattatgccagcccgtgtgtttagacagtgagtttttgaggtggccgaattttcggcagccctagattttcctcacaagtgcggaatgatatttactgtgtttgacggaattttagtgttgaacgtgtgtcacacactcaaaatatagcctaaataggcccttagttatctttatcttcacgcatcatttcaataaacccatccaaagtagaagtgagctcatctaaagaaagcggtgtttcagcattgtttatcatatccgctaaatatgttaaaaattcaaaactgatcgccgcatccttgtattcagatttttgttcaaatgttgttaaaacagcatctgaaaacaagcgtattgcaaaggcgtaatttacgcggtcgttaaagttagctagttcatcgtctatttcgttcgcaacttcttcgcgatataacgtatgcagtaatggtgatacagttttttctttatttgacattgaaagctgttcgagtgtgtcggtcacgctaaagccttctggaacagattctccttcaggaatgcctatttcaatttgagttggttcgtttttctttacaaacttatcaatactaggaatttccgagatgccctgaatgtagggaacactgacatcaaaataatcggccagcgctttccatgtttttaaacgaggttctctacgttcattttcgtagttacccaaagcgccaaaagaaatgccaacctctttgcctaacttacgcagcgttaagtttcttttttttcgtagctctttaattctattcatattgtctacctcattcatagtctaacaagttttgtgttcaaagtgaacaaaatatgttgacttttttgtgttcgtagtgaatacttttattgtattcagtttgaacacaaggaggagtgaacgaaatgcaagcaatcatcacagagacacaacgagctactttgttgcgtgaacaagggtatttgaagctcaaccgtcgagacctagcaaagaagttgggcctatcgtacggaacggttaagacggtgttagatgcgccaacgcccctaatcgtcagcggcaagacgtttacagcggtaaacaactttctaattgaccagttggccaagcaataagggggatgcagaaaccgcaaacagatttagaagagtttgaggtattaggctatgaaagtcctaaacctcaaaagctagctagtgaagcaaggagcaacgcaatggatcatttagttatgtatgccaacccaaaggacggcatctatacaacaagcgagattatcgcaaagtacacaggcgtatatattcacacagtcgaacgactaacccgtaagcatcaagccgaattagaagcgtttggagttctcggatttgaaaaccgaaaactagcagcaactggacggccccaaaaggtttggcattacaacgaacaacaagcaacgttgtttatcactttcatgcgtaatacacagcccgttgttgaatttaagaccgcattagttgccgcctttttctcacagaaagaagaaattgcacacaagcaagccttgctaaacgacctaaccaaggtcaataagtcgcttgctgacgttatcaaggaacgctttccagaatgggcccacgcttattcaagtatcaacaacctagccttaaagaaggtaacgggacttgatgcaaggcacctaaaagacaagttcaacgttggggatgccaaggacgcactaaccgcggaacaagtcgaacagttggaaaaagtccgagaggctattaagtcattgctgctaattggctttgattacaaccaattaaaagcaacaatggccgcatagcatccccacataaatttggaaaagtcaccgtgtcgcataactcattggccgcccgccggttatgacggcacgaaaaaagccacccttgcgaagagtgcaagaatggccgtgacgatttaagaaaggaattttaaaactatggatgcacctattctaccacaagggcctaacaacctcttagagaagcttattaacaaacttgaccaattaggcgatgagctacaccaagtagcagagacgcaacaacagccccaaaagaagtggctcaacatcacagaggcatcaaagtacacgggccttaattaccgcactttaaagaaggcgttgcaacgtgcacacatcaaaggccaccaagtagccggcacaacggtagtcaaatatagccttgatgagttagatcaagcgattatgcacaaataagaaaggcaaaaacatgactaatcaagatttaaacgtggctattcaacatatcaaggtagctgttgaggagtttaacgacaccatcgaaaatgaaaagagtgaagaagctaagttattagcgattggcacaaagtttggcatgaagtgggtagccgacttgttgaacaaaggtgagattgacactttaccggtggttgcaagccaacgttacaagcatacccgtaaccaagtaatgaggcgtgagggcatcaagaagaaaactgttgaattaccaccgtttgagttggggtttgaacttgctacccatgcaatcgttgaagcgattaacgacagtttcatgaatacagagacaaaggccaccacgttacgaattattaaccaccaactaagtaacctgaacaaataacgggggatgaaatatgacaacagaaagtgaaatcgaacgtcgcaactttgaaaacaagttaactgacttagtggcatacctaccagaaggccgtaacaaccctgtgaaggctcacgagttagcggaacatatcggagtagacaaacgcacactaagcgcctatgtgtcgtatctgattaagcacaagggcgttccggttggtagcagccgacgagcaccaagcggttattacatcatgacggatgaaactgaccgcctagccacacttgcaccacttgaagcgcaagcaaccgaggaattgaagcgggtaaactcgttgcgccacatcaaccttgatacgtggcgttatgaatttgaattgaaccgaaaggaattaaataagcaatgaacctatcagcttttaacgccgaccctaattggcaagcaattacagccgcttacttgttagctttgtcgttttatctatatacgtcatcagtcaataacaagaagtcacgatttgacgggcctgtttctgaaattctattagccgttagtgtgtctttcttcttaagcgcactatttacccggttctaattgaggtactaaacaatgatgatcaagaaatatctttcaacattatccgacatgcaagcgttccttagattggttggactaggtgatgtagaggcaaatcagagaatggatgccgcaggtatgctaacgggtttgggcattgatttggacgttatcaagcatccaaacgacattttgccagcgttgaacggttggtatgataccccgcaatattcagagcaagacttacccgaaattatgcgtcgattgagtcagatttacgcagccggaaaatttacacgacagacatttagagcaaagaaaaagcccgttgcgtgaacaacgagcaatctcaaccaaatttaacggtgtgcaagttttgaccgaccacacaccgagaaaggtcttaattatgttagcaacatcacatatcacaatcaatagtgaggcagtttcagagttgccattgtcaaccgtagcgcggcgtttgcgggcgtatctagctaagccggtatctttattggctgggaacgcaacgggcgttttaatgcatgttgattggtggctagaagatgacccaaccggcacgctcacagcaccagagttttatgacattgccaaatatgatgcggatgccgtattgccgtttggatgctttgggctcacatcagaaattgcaaagcatcttacacaaatcatttacgaggaacaaaacaatgacaaccaaaatgcgacaaactgacaaccaaccagcaaccaacacacgggatagcaagagtttggtgaaagaaattcaattactgccggcaaatgcatacttattggccgtacaaaccatgaatgcaacggcacacggtgagttgttgaacctcacagcagagcaagcaaatagtctttctatggtgtcggatcatcttttagagtggttgggccttacgattagtcgaaacagccaagacatccaatcagcaacaatcgttatcgaataatcgtgtgccccagtcatggccataaactgaccaccaccacacaacaatattatgtttgccgatatggcagaagggtttttagatcatggataacaagaagcaagaaacaatggatgaatacctagcaaagaaagcgccggcattgcgtacaactcactatgagaaggtggcggtagaagtgccggataagtttggcattgtacgagcagcacaagagtttctagccgcgttacattttgctgatatgcaagatttggacgacgaccaagaggcagtagcaaccaacatcaacgtacaaagcgcgtgggcagacctacaaatggactatgaaggcttatcagaagatatgggtgataagcctcattttaacaagaagtgggacacagaccacaacaacgattaggcgtagtttatggactaacaagtaattatccaagacgccacagaaacaagctcacacggcttactggtggcgtcatacatacacgttccaccgagtgcacacacgaaatgcagggttccaaaatggagtaagcatgttgaacgccgagaagtcctttacagagtagaataaccaaactgttactggttgcggtggttgagtagcaaagtcccaacggctgatgtttacgtccgttctcatcagtgggcatacatacacaaacactattaaaggataactttattagttcttaccggtcaggggttggtatgtgccgcctgacatacataaaaaggccccgttagcccaccatagccaacggggtcaaacattcgataaaggaagtatagcacaatggccgaagataccgacaagacaaaataccatttgaatatacctgtaaaagtcgcggctagtggcatagtggataaagccgttattgtttatggagtgatactttctttttggaatacgacaagaaggcccgtaaatgcaactgatcaatacttagccgacttgttgaatactagtacacggtcaataagtagaagtattaacatacttaaagtaaataattacgtgactttaacatacaaacagagaacgaacgggagcaagttaagattagtttggccgttggttggtgagaatggcgaaagcattaacagtcatttgacgacggacacaagactgaaagatacaaagattatcaaggtcgaagtgttattaccaagaacatccccgacaaataggagagaaaaggtgcctagacctaacccaacatcagcagccgaattgatagggcttgataaatggcgagtgattggggatgcacttgatgagtatgatgtttttgcatcagagccagaaacacgtttactagccgttcacgtacacacaggagcaacaccggaactagttgccgaggctattaaacaatcaacatcagcaggcatagcaacaacaaaagcagcgttgcggttgctgacagattggcagaagcagggtgttaggtcacttgaacagcttaatgataagtgacattgtcacaaggatgtcttggcctgtcataagcggtcacgattggtttagaaaagcgcttagtgaaaattactaggcgctttttgttattttcatttgaatgatttatatatcctacggtcatttttggccggtggtctctattcgctcaaaaattgtctataaattactgaccctatcgccaaatatggcgagtggcctattgccaaatatggcgagtagcttatcgccaaatatggcgaggtaaataccctagtaataatacccaagtaataataccgacgggcagccaaacagaaggatgacgacgacgacccgctgcagcttgtttgtgcttgttggctggttcgccaagcagccgctatcatagtatatagggactaattatccgcaacggttcgccgagcatacgcactcataatatatagaaacaagttatttctaagcgcagctgctaaaaaatgacaacatgaaaatgctgatcatcaccttgccaacggataaacatgttttgtcgtcgtcggtcactctttggcatttgttttttcctcattcatttaagacacacggcagtttctagttaccattggataatttatcgttaaaaatagaaaatgccttaaataacaaatgacggctttctacgataggcatataattcagtaattaggacaaggggttttattatcatgatttggtttattgccgttgttatttgggcaattattttgttgttaccaaagacatacaatgctttgaaatttattttttcgttagcggtcttgtatggcatccgtgaagcgtttaactcatgggctgatcatcatgctgtattagctacaacgatagccatactattttttggcagcattattggcgtttgggttgctaagcaagtacagataacaagagacaacaaaagaattgatgcccaaaatgcagctaagagggcagaacaagagcgtgagaagcgtagggtagaactagaaaagatagatagcgaaatttagtgacggatagcattatatgcttatcagcgtttacagcgttagccacacactgttttcaagtctgatttggataattcaacatgacttatagaaaatgtcacagagggcaaattagagcgttttatttgggtgttgtaatttgctgtatctaatctgaacaacgggtttaaaaatgttcaaaataatcacaacatggaacacgatttggtagcgaaaaagtgtgcacacaaaacaaaaaggtgtgcacactttttttaaatttgtacgcgtacttttttggctttgtactcatactttttctagcagtttaaagggagcgctccttttaaaacagagcgctccctttggtgtatggaagcctttgggttgttaagaattgttaaggttaaatgctaggaattgctaggcttgatgatagcattggatgctggaaaatgctggagcgattgttaggaaatgttagggtgtagatgctaagaaatgctaaggtcagatgttggaaaatgttggactaaatacagggggatgaattgaatgttatccatgcttgatacaagtaaagagttagacgagaaagcgaccattaggaacgttcgagagttctttaataaagagctaactattagtttttccagatgaaaaagttggtagaagctatgatagctaccggttatatagttgtgcacttaagaaaaattattattcatatatccctagtaatttacgaattaagctatgaaagtttagtatataagatagccgttaaacgtttatgtttagcggtttttattgtgtaaaagtgttgatattgactacaaagtaattgcagcttttccgattggtaaaaatacagtaatagaacttaatgaaatgccaataatttcaattggccaactcataatgattgacgatataaaagttaaagttattggtattccaatgttaccgcccggcaaacaagctatttatgttgataaggttgttagcggtggtcaagatgtgcatgtatgaagttatgtgtatttaagcaataggaaggactactacagactataaagtaaaataagtggaattttatgtgatattcttgagaaagagtataaaaatattagaaggtggatattagttttgagtgattggattgctagtgtaactactgtagcggtaggtgcgattacagcttttacgggttataaatataacaaattacaattgatttctaatgaaaaagcatttcttgaattttgtttacaagaaacttcagatatgcagtttgtaaggaatattggaattaatacggctgtgaatgtgaaagtgtacaaagtttttttaaatattaattgtgtaaaaaaaatatttggtaaaaattattacaaaagaggtacggtttctttagaacagtctttagggacaataatggcaggtaaaaaaagaagataaagttagtaccagaaagtcattcatatgaaatttttataattgagtaccagaacatttcaggggaaacgtatcagactattttaaaacctcaaaatgggcgtggagatcatgaatttttgtatattccaagaaaaataagatcaagaagacagcaactagagggaatttttaaaagtaaagaaatttcacttcctaggtatatacgaaaaatttatttccctaaaaaataattttgtatgatcgctcatttatcataaatagaagaaacataatcgaaatggtgaattgaataaatgtttgggcaatgcattctatgaatgacattaataaataggtagatgaatttaaccgcaaaatgaacattagcattaatttgttaatgtttttttgtgttccattataattttctactatataagtagttcattgaatgccgttgattgtcatacgtgtttgtttagtgttgctggtagctatttcagatagctgacaagttacatactttgtataatagtaaatgactgttagtattcctgaatggaatatgaaactaatcattagtaaatttcagatagctaggttcattggcgtcaaagttaccgagtgaagcggttatgccgtcttgatgaaagtgtttagcccagatataaacccgcagataaataaactttttagaagtaatctttttatcaagtaactgtttaaagtagcgtggatatatgttgtatttgtctaagagtggttgaacaatctcatgtacaactcatgtacaacgacagtaaaacgaaccttatcaatgccagcaaggctattaaatttatcagtagcgccaatattatcaatttcatttgtatctatgaactcatgcaaacgcaaccgccagtaatctaagtcgctcatcatatctaccaccaccttttttaaagctagtttagaatactctcatagctgaaatatcagccatgccatggttcgctacatttggttagcaattggtaaacctatacttgtaatggacgtacctgaaagtacgaccgttcactaataaatagacgttatataaacgcattctatgagcgttttttaaagtaagttgggcaattataaatgttgcgaatgtgttgttattgtcgtgtggcgttgaatttatccaaatccccatgctgtacgttatatagtgttgttgaattatctaagtggcatctagtatgaagcaggatagcggagttgtccgccaacccaaagccaaatacgaacacggctgttagataatagggtggcagaagtttcggccacctcttttaggtatcgtcaatattaacgatacccaatcagacattgatggggtatagccaatattgggcagacccatttgaggcttgcttagaattaagcagacctatttggggtttgccgagaagtcggccaaactaatttattgattaacgagcgtagatttgagcacgtaacattcaaacaagttaaacggtcatagttggccaattgtttaaatgcagaataacgagacaatttgtaaacgagcaaaacggatattttgatgatttagacgtgttcgtttgtctcgtttttagtaagtatatgtcagtgttgatgtcaagaaatgtcaaggtaggatgctagggcaaatgctaagaaatgctaaggtcagatgttggacaagatgataggaaatgctaaggggaaaatggtagcatttggtaacgtgtgtttgttatcctgtgtccctcaaaaggacagcgaaatttacggtggtagtcactcatcagtgaccggcattatttagaacgatcgtacttacaggtactaccattatcgttttgaacgacaatgaaaaaacgccagaccgtaattagcccagcgcaatgttttcctagcagtaactaacattgtagcacgagggtaggcggatgaatttggatagaaataagacggctaaagagttgcgaaagttctttaagaaagaggtttggtttatattcagtgttagcgaatactggtacaaataccctgacgcatccccaaacgatttgccaaagattgagctgtacaacgacggcagccatttagacgagatgcgagggtataccaacagtattattgatgcgctggaaaagttgccagcccttgaacgcaatgtgatttggtggcggtatattaagaaagaaccggttattgatgccgagcaacgatttaacatcagtgggcgccgtattcaagagatagcgcagcaaggactagtgatgtttgcggatgcatttgtagggacgtatgattttagagtgatgcagtaacgagtgatcacgttgtgtttgggccgtgggtgtcttttcttttgtttcgttattcactcgtttaacatcaacgtaaccactgacaatctgtttgctgtaaatgcttgtatataataaaaaacgccttacaatcatgtaagacgacataaggcaggcagccacaatattaaacttaattatgttattgataccgttattcattggccgagtaacggtatttttttttattgttttgaccctaaaaaagagggtcgcattttgggtcgcaactaatacaaaacagtacattttcgtacaaattagatgcgaccctttttgcgacccaaacgcttatttcaaaggataaacgccagtatatcaacgtttctaacctcaaatatggagccgaggggagttgaacccctgtcctaccatctcgttactaacacgtctacgttcatagctgaataatttaagtctcatctagtgcacgccattccgcgcggcgatcaactagaccagcctgattatcctcttccaaccgccctcaggtggcgaacggttggcgcagattacttagttttaaaacctagcgcaacccgtaatcaaagctgtgcataggcaacgcaggctggtttttaggcagctactgcgtaagtgttttgtgaattgtttgcagttaattcttctgagtggattatagggccacaacccctaaacgcagtgctagcacgaacaatgccagtcgattccgtaacgaccccgaaagttttactaacagtgtttagtatagcaataacaagggcgatgcacaatccatcggggggctaaatggagatgctaatgatatttgagattgtttcaaaagatgaatagttaaggacatttcataaatggtagggttaaattacggacttcacataaaatgtatttccgataaatgaaacacagtgtttactgttacttttttgagtgaaaagcaacacgaacatggggtccgaaactgttgctgagcgtgtcctaccgtataaggacacagaagggggatattatgacgaaggaaaaagtagccattattggggcatcacacggtggtcacgaagctgcgttggagttgctgacacaatcggataactttgaggtgacgatttttgaggcgggagacttcgtgtcatttatgtcatgtgggatgacattgtatttaactggtcgagtgccagaagctgaggcggttcgaaactttaaaccagctgatattgaatcacttggtggtcacgttttaaataacacaaaggtcacggggatcgatgcggataagcaagtactcacattaaatggggatgctaaggcgcaattcgcttacgataaattgattttgagtgtcggggtgacaccggcccgtttagcgctaccaggatcagaaaatgccaatattgtgccgatgcgtggttatgaatcagcaaagcaattgaagacctacatcgatgatgacagtgtggaaaatattgcggtgattggggcaggatacatcggtattgaagcggttgaagcgatggttgaagctggtaagcacgtgacagtattggatttgttgccacgagtattaggtgcctatctcgatgctgatatgacgactcgtattactgacgcattgattgaacatggtgtcgctgtgcacgtcggtgaagccatcaagcgttacaagggcgatgataacgggcgtgtaactgctgtcgtgacagatgctggtaaatatccagccgatgttgttattgaaggaattggagtaaaggccaatacaagcgagtttgccgatgttttgcaacttgatcaacgtggctggattgaaactgaccgttacctgcgcacgaatttaccaaatgtgtatgcgattggggatgcaattaagccattttatattccgtctggtaagcaacaacccgttgcgttggcatcaacggcgcgtcgtgaagcccaatatgttgcgcacaccattattaatggcgaagccaaggcaccgttcaagggtgtggttggcgcttcggcgctatctgtatttgagtacaactttgctagtgcagggttgaatgaggttactgctcaacgttccggcgttgagattgcatccgttacccttgttgacactcgtcgtccggcgtttgtgcctgacgtaagcgggaatggtgagattattgtgcgcctggcttacacacctgaaacacaaacgattgttggcggggcggtgatggcaaagcattacgatgtgaccgcacatggtaatacgttggccttggcaattgcacaacgtttgacactgactgatttggcggaagctgatttcttcttccaacctggctttgatcgacaatggtcatctttgaatttggctgcccaaaaggcgcttgggtacggtgaattcactaagtagagccgttaaagccgaacaaggacacaaaatattaacaattatcaacttgatttacgaataagttcggttataattatttcttgggtaaggaaactaccggtaaataaaccaaattccgaacattgttttatcgaggggataataaaatggacttttcaactgtatttgattacgaggatattcagctcattccaaacaagtgcatcatcgaaagccgctcagaggcggatacgtcggttgaacttggtgggcgtcggtttaagattccggtagtgcctgcaaacatggccacggttatcaatgacgacttagccatgaagttggctaaggaaggctacttctatgtgatgcaccgttttgcaccggagacacgtttggactttgtccgtcgtttccaagaagctggcgcatttgcatcaatttcagtgggtattaagcaagaagagtatgactttattgatcaattgaagacggcaggtttgacacctgaatacatcacaattgatattgcgcatggccactcagatgctgtgattaagatgattcaatacatcaagttgaacttgccagctgcctttgtgattgctggtaacgttgcgacacctgaagctgtgcgtgacttggaaaacgctggtgccgatgcgactaagttgggcgttggaccaggtaaggcctgcatcacaaagttgaagactgggtttggtactgggggatggcaattggctgcgttgcgtttgtgcgcgaaggctgctaagaagccaatcatcgctgacggtggtatccgttataacggtgatatagccaagtcaattcgttttggagcaacaatggtgatgattgggtcattgttcgcgggtcacgcggaaacgccgggtgaaattattgagatggacggagccaagtacaagacatactttggttcagcgtctcaattccaaaagggcgagtacaagaacgttgaaggtaagaagctattggtaccataccgtggctacatcgacgatacgttgaatgaaatggaacaagatttgcaatcagcgatttcttatgctggtggccgtgaggtaatggacttgcgttacgttgactacgtaattgttaagaactcaattgttaacggtgattcatattaatatttgttcagagagccggcatgatgccggcttttttgatatacttgttttttgtaattgagagataatgaatagatatttttaggagattaacgtgaaattatttgagcattggctacactatagctttgactggaagtcactaggcttggctttgttgattgttgtgatttcaatcgttttggttaacggtattgtgcgtggtattttccaccaaattgagaagcgcatccccgaccgatttgccggttggactgatgttttgatggcgtttgaaaacccagcgcgtgtgattgttttgtttacagggttactaattgccttgcatacagctcacgccccacatttggtgacgcattttgcacatgcgatttaccgctcagtacttatgttcagcatcgggtatggtttgtacaagttgatgggttcattgacggtactattgggccacttgggttcacgcattaactttgaacttgattcaattgtgatgccattcttgacgcgtagtttgcaattcgttgtgatggcgttgactgtgacgatgattttgtctgactggggcattaatgtaaacggtgtgttcgctggactggggttggctggattggctatttctatggctgcccaagacccaatcaagaacttgcttggtggtatcatcattattactgagaagccattccaaatcggtgattggattaagtcaccatctgttgaaggaatcgctgaagatattacgttccgttcaacgttggtccgcacatttgacggtgcgttggttattgtgccgaatgcgacgctgtcaaacgagccgattacaaactggtcacgtatggatacacgtaagttggcgttgacgttctacttggacatcgcaacaaagacaaaggatatgatggcagcgatgacggatgttgaagcgatgctagctgaagatgatcgctttgaaacgggtagtcaaaaagcctacatcaaccaagttacgacgcgcggtcacgagtttatggcaacggcccaatttaagatggtcgatggcgcggattgggctggtacgcgtgctgacattaacatgaagattattcgtatcttagcagaacacgatattcaactatcagccggcgtggatacgccaactgctaaggcataagaaagagagaattgtgatggcgtctgtacttttagcaatcgtagttgggttagcggccttgggtaactacatgttgttttccgtattgccacaagggtttgtccaatggttaagtgtcattggtcaggctgtgttgtcaatctttgcggtgattgttttctttacgtaccaaggtcgtaaggaaacgtcaggttatgaaggttaccgtgtttggacagttgcgcgtgtcattacgtggctagcgctatttggatcagtggcaacatttgtagtgatgcttttggctgcgatgggcattcttaagggaagcatttagtcaactattaaaacttgttttgttgtaattttgtaaaaaacttaaaatctgattgatattgtattgaactgtgaatgacgtatagtaattactatgagtaaacagggattaaagatgaatcaggttgcggttgcgcttttggttgcaactttaagctcgttgggtggtgtgacggtcacagcatctgacacaaaaataaatgctgtctcatcagcagcagtaaataaggcggtagctgcttcggtcgggggaaagacaatgaagatcaagcagattaactacgtgccaggtaccgcagcgccaagtcaacaaacgactaagacatacaagcaagttattcagccaaatcttgatgcaccggctgaagcttggatgtgcttggcgtatgtggcaggtgcctttgggggtgcgtcaggatatgcaacggctgcaatggccgctgacgatgcgccagttatgtacaacaatcaagatttcccagaaaacgtttatgtaccggttttcttccgctttgtggatcaagctcacggtagcgttggtcacgttgtgatttgggatggatacaagaaagaatttctttcaactggatcaagcaatggacacatcacgttccattcggttgatgaagttttggcatggctacgtggcagtggcgatgttgaatacattggttggtcaactgaaatgccaattgatcaccaatggcgtccagttgtggattaatagaaaaaatgacgaaggtcaagtgcgttttgcgtgcttggccttttgttggtattcagggagtaaacgcggtacgatgtagtcgtttaagagatgctaattgtttaatttgggggacgattaaatggcagaatacgattatgacgttgtgtatttggggactggtcacggaacgtttgatggcgtgataccactagcaaaacgtggcaagcgcattgcagttattgaggatggcatcatcggcgggacgtgttccaattatggctgcaatccgaaaattacattagatgcaccagttgcaatgctccgttcgttggagaatatgcgtgatgtgttgccggtgaaagatgcacacattgattgggcagccaatcagaagcataagcaagccgtgattggcggtattccagacttaaaggtcagtcgcatggaagctgtcggcattgaaattattaatggctacggcattttacaggaccgtcacacagtcaaggctggtgatcgtcagctatcaactgacaaaattgtggtggcgactggtttgcggtcgcatcatttgccgattgaggggacggagctattccatgtttcgaaagactttttggcgttagaagaaatgccggcctcggtcgttgtgattggggcgggttatatcgggatggaatttgcgacgcaagcaaatgcggctggcgcaaaggtaacggtaatcatgcatggtgaccaagcgttgaaaggctttaagcaagactatgttgagcaaattatcgctgatttaacgaagcgtggggtaactttcttgcgcaatgttagcttgaaaaaggcagagcaggttgataatcaagttgttgtcactgatggcgctgatgtgacagttgcggctgattgggtgttggacgcgacgggccgtattccaaacgtggaaggattcggattggatgaggtcggtgtggcttacaacaaaaacggtattgtggtgaatgatcatttgcaaacgacggttgataatatttatgcggcgggggatgtgattgataaaacacaacctaagccgacaccgacagcgattttcgagtcgaagtatttgatgcatttgtttgcgggcgatacaacggcaccaattgattatccggttattccgtcagtggttttcacgtcgccacgaattgcaaaagttggtttgcaagctgatcaaattacgactctggataagtaccagattgaaacgcatgatgtcttaaagaactggtaccgtaacgtcatgaatgagcagtttggtgaaaacgaattgatttttgatgagcaacaccatttggtcggcgcaactgaaatgagcgactacgctgagcaagtgattggtacgctattgccgacggttgaactcgggttggatgccgaacaagtcgaacgcatgattcacattttcccatcgttggagtcaattacttgggaacaaatctagttgatgatctgttgacatgaactatatgaccccgtatagtagacaaagttgaaaattttgaatagttcttttaactgtcagccgagagctggccaaagagcgcgtcactaaggataactgtagactttaacgggccgctctgtacattttttgttacggagtggcccatttttaataaaacggttaaccaaggtgcaaggaggggaatatggaaaagcagttcggtcgcgttgaagtgatttcagccgacaagcgtacgatgtcaaattgggatatgtttgccacatgggtgggcgcaaatgccaataacggaacgtggtacatcggaggtgtgatcgccgccgcaggtatgtacacagcgtcaacgacattgattatttctggattggtgtcatatgctttgttggcattggcatcattcatgggttacaagacgggattgccaatgatggcattaacgcgtgcgtcatttggtttgcgtggttcatttattccatcaatcattaacattgtgcaatttattggttgggccgccgcaaatacatttatcgccgctatctcgatttcggtcatcttcaaggacttgttcggttggcaagcctacacagctggtggtaaggctggtttggtcatcggaatcatcatcatgtcattgttgcacttggcatcaatctcattgggtgagcgttcagttcgaatgattgagcgtatcggaatcgtgttggttttcatcttcgtgctttgggaatcaattgtggtgttccaacacgtgtcattggctgatatcttcgcttggaacccgccagcaaaggtacgtatctcatcaggtgccgccatcgatatcttggccgccttcaacttggcctgggtaacggcgtcatcagacttctcacgtttcacgaagcgtaagtcaggtgcgactggttggtcattcttgggtgcgaacatcggattgttctggttcgccttcatcggtttgacagccacgattgcgacggccttgatgaacaacgcttttgatccaaacgactcagatccatcaacgattgcatcaaagttgggcttgggaattatcgctttgttggttatcgtgattacgtcaacgacggccaacgcggttaacttgatggccgccggatctgctttgacaaacatgtggcacaaggtaaagctaacgccagccttgtggattgtaacgattgccgcaacacttgtgtcattcattccattgtggttcgccacattcttggatgccttcatcttgttcttggactacatcggtatgttcttgggaccagaaatcgccgtcttcttggttgatttcttcttcatccgtaagggacaatacgcacttgaccagttcacgaaggtggatggtaagtactggtacaacggtggtttgaactggattgcgattgcctcatgggctgttggaattggattgtacttcggtttgaagtcagtgaacatcattagccaaacgattggtgtaactttcgtggcgatggcattgacgggattgatttactacgttgcaacgaagctaattaagaagtaaaacagtaagcactggaactcaatttgggttctggtgctttttaatttgtggtttgtgttcgtacttacgcacgaagcaaatggggcgggtctagtctatttcggtgggttagcgacgacacacaaacttaaaatgttaatttaaaactaacctcatatcacgtataatagaactcatgcaaaacaagaggaggtccgtatggctaattatttgattattacggaaaagccatcagcggcgcagaacttcgtgaaagcgctgggcggtaaagttggtagctttgaaggcaataacttcaatatcacaaacctgcgcggtcacgtgatgacgcttaaggagccggaagaaatggtggcgccggatttgcagaaggcctacaaatcatggacgttgaagtacatgccatggaacttggccgattttaagtggcaacgaacttatattcgtagccgtaatctgcgcactggtaagtctgaatcctcaaagaaattacttgatgaactaaaagccgaaagtaagaagggttatgatgcgttggtcattgcgactgatacggatccgtctggtgaaggagatttgttggcatgggaagcgattgatgcaatcggctggaaaggccaagtattgcgtgctaatttcatggatgaatcaccgaagagtattaaggcggccatgcgtgagttgactgatgtcacggataaaaatcaacacggtgcctacatgaagggtgaaagccgtaatcgttgggatttcgcgtcaatgcaattaactcgtattgcgacgacttcagcgaagaaagcgggctacaaggtggtggcgcgtgaaggtcgtttgaagtcagtgattgtttggaagatttatgagcaacttgaagcgattaaaaactacgtccgcacgccttactatgaagtgaagtttaaggacccggccgggcacgtgtttggtcgcgtgaccaaggacggtgacgtgattccgtggcgctttgcgaccaaggatgagggacaagctgatatggcgcaataccacagcagtgcggtggtgaacgaaaagcaccagacacgtacgcaagccccaggtcgattgcttgatttggctggtttggcggctgtgttggcgccacgtggttatgcttcaaaggaagtcctggcaacgtatcaaaagatgtacgaagcccaagtcgtgtcgtacccacgtacagaagacaagacggtgacgccggaacaattcaatgagttgctgccattggttgatcgcattgcggacctggttggggtggataagagtttgctaacgcatcgtcagccacgaccaacccacgttaaggcgcaaggagcccacggtgcaaaccgtccgggtaccaacgtgccagctgatgtgcagagtctaaagaagtacggcgacagtgccatggcgatttacgaggtgttggcaaagaactatttggcgatgttggctgaagattacgtgtatgaccacgtcacagctgaattgcaggattaccccaacttcaagacggccttcaatctacctattaagttgaactttaagttggtctacgattcatatgcggcaacgcgtgtggatgacgatgatgaggatggccaagcaggcgcgcttggaccaatggctgacccttatttgcatgaaggcgcgaataagaagccacaacacccgtcaacgaagtggattatggcttatttggaaaagcataatgttggaaccggtgcgacgcgtgtctcaactctgtctgaaatgggcaagggtcaaaaggcgatgttacgtgaggcgaagggtaagctgacgttgacggaaaccggtaatgtctcagcggtgatggtgaagggcacgtggattgcctcgccgaagatcaccaagcgtctattcgaaatgatggatgaagtcggtgagtttaagatgacggtgccgaagttgcttgaatccgtgacgcaagtggttgaacatgacatgccaatcatggtcgcgaatgccgaagcgttgcaggcaacgttgggtgcgccaaagcctaagccagttcgtaaagtcagtgagaaaacaacaggaacgttcaagggtgaagagattacctttgctaaggaatggagtggccataaatttaccgacgaggaaatcaccaagctgttggcaggcgaagaaattagttttccagctaagtcaaagcgtggaaaagcttataccgcagttggtaaaatggcaaagcaaacctttaagggcagcactttctacggctttaaattaaatccaaaagataggaaataagtggtatactcgattaacagttcacaacattaattttttccagggagagaaagaaatgctaatcaagcaagtgttaattgaaaatgcaactgaaccaaaggacgtgcgtatcgttgatggtaagtttgcagaaattgcagataacttgacgcccgaggcaggtgaacaagttatcgacgccacaaacaagttgatgattccaccgttcgtggaccctcacgttcatttggactcaacgatgacagctggtgatcctgagtggaatgagacgggaacgttgtttgacggtatccgtatttggtcagagcgcaagaagacgttgtcacatgaagatgtgaagcaacgtgccattcaagcgttgaagattcaagctgctcacggtttgcagtttgttcgttcacacgtggatattacggacccagacttggtcgccttgaaggcactgattgaggtgcgtgaagaggttaagccttggatgacgttgcaattggttgcctttccacaagagggaattttgtcattccctggtggtaaggaattgatgattaaggcagctgagcttggtgttgatgcgattggtgccattccgcactttgagttcacacgtgagtactcagttgaatcattacactttgcctttgaagtggcgcaaaagtacaacttgttgattgatgcccacacggatgaaattgatgacccagcttcacgtggtttggaaacaatggccacgttggcgcttgagaccggcttgaaggaaaaggttacggcgtcacacacaacggcgatggggtcatacaatgatgcctacgtttataagttgatgcgtttgctaaagatgtcagacattaactttgtggccaacccattgattaacatgtacttgggtggtcgttttgatacgtatccaaagcgtcgtggtttgacgcgcgtgaaggaattggatgctgaaggtatcaacgtggcgttcggtgaggatgacatcaaggatccatggtacccaatgggaaatggtaacatggtcgatgccttgcacatgggcttgcacgcgacgcaaattatggggtattcagaaatcatgaattcataccgcttcattacgaagaacggtgcccgtacgatgcacgtgcaagattcatacggtattgaagttggcaagccagctaacttcttgattttcaacgcaacgaactggtttgatgcgttgaacgaacgtgccgaaatgttgtattcaattcacaatggtgaggttttggttgaaacgaagccagcggaagcaacgattaatttgccagaataatagggaaagcgagtgaacttgtttcgctcgtttttttgtgcagttgcgtataattagtaaggataaaaaacgaaaggggtgtgggtcatggcacggtttccagaagaacaaacagaaatgtatttctggcggcacaagttaccagaacagatttatgaaaagaatagttttgcaaatttaatggcgcacaccccggaatcggaaatgaaggcgttcgcccacgagattttcgaaaaactaccaccagagctacaaaatcagcaagattatgatcaatggttgttggcattgcttgaaatgttgcaacaaccacatgatgtgcccgctgtgatgcaacagttgattgcggggatgttggccgacgacacgttgacggctggacagcatgaggtctggcaggatattgcggacacgccaacgccgatccagattgtgactgggcgtgctgggtcaggtaagtcctacatgatggcccgattgattcgtttggctcagcaaggcgatgtgaatacgattttgattacgccaacacacgcagctgcgacgaatgcgcgtggtctggttgaaagggcgattggtgatttgttggacgaacatgaaccagaatatctgttgaagccggttgatcacgtgacgattgcgacggcgacaagttttacgtaccgtaatcacgaagcgatgactgaaattgcacgcttaggacatttctttgatgacccagaacgcgcagcccgttactcaacgtacgatttaatgattgtggatgaggcgtttgcttcaaatgtcagggccctaattgatgccattttgtatggactggcgacagggtcgcaaatcttgttggtgggtgacccaaatcagttgccatctgttgaaaacgacccggtaccaatgctgaatgccttggtattggctggactagcgaaccgcacaccagtcttacaacaaatcaagcgtgccaattcaccaatcattgcaaccgtcgctaatgcgattttggatggtgactcaagtacgattgtggccccagatgaattgatacccgctgaggtgttgccagaggtctttttgacgcgaccttatacgtttgcgccaatgagtgaaacggcgctattgcaggtggttgagacggtaaagcgagcgttgattgccgaaccggaaaacgaaacggttgtcttggtaccaacaaatgaactacgtcgtttgattaatgcagccgtgcaaaacgcattggtggcaacaccggtgttacgcactgaagttggcttgtgggtgcgcgatgacttaacgctgtatccgggtgaccgtgtgcaagttatgcaaacggtgtatgtcacgaatcaagccagtggggcacgtgagaaggttcgtatgcgtggtggagaccgcatcacggtggttgatgtcatgccggattatgacatggtattggttcaaacggttgatacggctgatccaattttggtggatttgaacgaaacgagtcagactgggtttaatccattttcttacgggcctaagctggtcagcgtccgtgaaaacctcgacctggggtatgcgacgacgattcataaaattcagggatttacattggataatgtgattgttgttttgccaatgatttcaaaattcattacgacaaacctgatttattcagcggtgacgcgcgccgccaatcatttggcaattgtggcatttgcgaacgaattacagcaaacattggacaatcatgtgggacatgaccgccaagcaatgcgccgtgttcaacaattgataacagaaacatctcagacacaattatcatagttaaataacaacattcattgaaagggcgtgttcatcatagaaaacacgccctttcttcaggtaatgcgaattgtatatccgaaacatcggagcgtaccggatttgcaccgctttttttaagtaagagtgaagtattccgtatttacgttgtataatatacggtataaaggactgtggacggctgtgataaaaaaatagctatccgcgtgtaagtggtttaaaagatgtgaagttttttagaatagtcgccagattttgtagacgttctgtgaaaaacgcccaatactcgcttttcttttgttattgtgttaggtgtacaaataaagaattgattttgtaaaaactattaagacggggaataagaatatgaaacttttgatggtcgaggataacacgtccgtttcagaaatgatgggcatgttctttaagaaggaaaactgggacgctcactacgcatacgatggtaacgatgctgtgacgatgtttaatgaagatccagagtcatgggacatggttatcttggatttgaacttgcctggtttggatggtatgcaagttgcagttaagattcgtgaagtatcaaagtatgtgccaatcatcatgttgacggcgcgtgattcagaatcagaccaagtgcttggtttggaaatgggagctgacgactacgtaacgaagccattcagcccaatcactttgattgcacgtatcaaggctttgcaccgtcgttcagagactgctggtcaaccagcatcttcagaaccagctgtgcacgaagactttgacgtacaaacacgtacgttcaagttgaactcaaacacgcgtgaagcttacttgaatggtcacttgattcaagatttgacgccaaaggaattcgacttgttgcgtgtcttggctaagaagcaacgtcaagtgttctcacgtgagcaattgttgcaattggtatgggactacgagtactttggtgacgagcgtacggttgatgcgcacgttaagaagttgcgtcaaaagatcgaaaaggttggtcctcaagttatccaaaccgtttggggtgttggatataagttcgacgattcaaacgttgccgctgatgaagaggcagaagcttctgctaaggcctaagctagtttgaagagaatataagagagattaacgaaagatcaccacgtcatcctggcgtggttttttggtaaaacaacatgaaaatgatgtaccagcaaatgttggccttctttacggtcatcatggctactctggtaattgtcggcattttgtttacgcagtttacgacgaagatgattgaagataatacttatcatcaattgaatcgttatgcggttgccgtggctgaagaggcgatgcgcttcaaggctgatgacggttcctttgcctacttcgatacgaagggactggaaacggatgcgtcattgctagaacaacaaaatattagttttacgctctacaacgatgaacgtaagttggtttatcctgagacacaagctaaggagactgctaacgttaccgatgcagagtgggcacaattaaagcaacataaaatcattcaaaaacgtggggctaagcaagctaatccagcagataattcggcagcgaatacgatggatgtgatgaaaccattcttcgacaatcagaataaactgattgcggtggttgttacccgcgcgaatgtatcgactgtggcagacaacatggacatgctgcgtaaaaacttgctgattgccttcttggtatcagttgtcgtcgcggttatgttgagtttcattttgtcacaattgattgttaaccgtttgcgtttgattcagttagtgacgcgtcgtgttgcgggtggtgattataccgcggctgttaacatgcatcgtcacgatgaaatcggggctttggcggaagacgttaacgtcatgaccaagtcattggccgaacaagaacgtgaaatcgaagagcaagaagaacgtcgtaaggaattcatggccaatgcgtctcacgagatgcgtacgccgttgacgaccatttcaggaatcgtcgaaggattgcaatacggggttattcctgaagatgaaaagatgcactcatatgacttgatcaaggccgaagccgaccgtttgacgcgtttggttaaggataacttggactatgagcgtttgcgtcagaacaaggttgtcttgaagaagaaggaatttgattcagtaccagtgatttcaaacttgattgaccagttggctggtaagtctgatttagctggtgatgaaatcaagctgcacgctaagacggcagtgccagtattcgctgaccaagaccgctttattcaaatcatctttaatattgtgaacaacgccattcagtttactgagaatggattgattacaattgatgcttggcgtgaagctggcgaagcgcacttcaagatttctgatacgggtatcggaatgaccgaagaccaagttaacaagatttgggagcgttactacaaggcagatccatctcgtacgaagaagggtgagtctggtttggggatggcgattattcgtcaattgattgaagtgcacgatggtcaaatttcggttgaatcacaaccaggtgtcggcacatcattccacgtcatcattcctgatgagcaaaagaaaaacgactaatcttcataattaagacttaaagtctccggtaacggggacttttttgttgtacttgaaaacgattgtcttataatttgttaggttgatatcgagatagcgctaaagtcttttaaatactggactctagctatagtttaattggtagcggttacatttttttgaaagcgtttcaaaaaagttagtaaaaagtgttgtgtaaacgttttcattatgttattctaaatctcgttgataaataaactaaaaatatttaagattgtgaaggaaattttgctatgtcaattttgattgcacttattcctgcgttggcctgggggtcaacgggacttgttacgactaagatgggtggtactgctgcacaaggaacgttgggaatgacgttcggtgccttcgtctttggaatgttgacgttgggattgtttgttgtcccacaagctggtatggagtttgcctttaacccacgcatctggattgtcggattcgtttcaggtttgttctgggcagttggtacggccggacaattcgttgggttcaagaagttgggtgtttcagttggtaacccactttcaacagccggacaaattgtttcaaacgctttgatggctgcggctgttttgggtgagtggacaactggtcgcatgtggacgtttggtttgttggccatcgccgcagttgtgattggtgctatctttacggctttgccagattcaaaggcaccagccgaagttaacccacaacacgacttcaagggtggtttggttgccgttttgatttcaacgattggttacatgatgtacttcgtgttccctaacttgttgaacaagatcggttacatctcaaacgccgttcacaaccgtcacgacggtttggactacatgacagccattgttggaccacaatcaattggtcaagtattgggtgccttcatcatcgttatcttctttatgaaggaaggtaagacgatgttccaaaagggaacttggatgaacatcgtgactggtttggtttgggctttgggtaacgtcttcatgtttatctcaacggctaaccctaacatcggtcaagcaacggcttcaactttgtcacaaactggtatcatcgttggtacgttcggtgccatctacctattgggtgagaagaagtcaaagcgtcaaatggtcttcgttgttatcggagctatcttggttgtcatcggtgcaatcatgattgcgaagttgaagactttgtaataagaaattaagcgtaacagaacccgtcggacatagtgctcgacgggttcttttttcgcaattttgtccggtttctaccatatctagcaggtatgcttagagcaaacatgtattcgggggaataaaacatggaagctaatgattatttggcaattgatattgggggtacgcgcatcaagtatgcggtactagatcatgcaggaaacttgattgaaaaggacgatgtggcaacgccgaatgaaagtttggcagaatttgtcgcagcggttcacacgattgttgatttataccgttaccgcattaagggagtggcaattagcgcaccgggtaaggttgatcacagagatgaaaccatctatgcgggtggcgcattgccattcctagataaggtgaatctagttgatgagctgcaattggatatgccagtcgcagtcgaaaacgatggtaaggcagccgcacttgcggagctttggttgggtaacttgaacggtatcgataacggggcggcagttgttttggggaccggtgttggtggtggtttgattttgaacggccgtttgcacacgggtacgcacttccaagctggtgaattaagctttatgcatcgtggtgaggcacgctttgacacggactcatacggcgttgttggctctgcagttcaaatggtttcaactattgcgaccatctatgatttgccagacaagaaggatggccgagctgtatttgagttgattaataagcatgacggaccagcatgggatgtctttaagcgttatacagatgacctggcattgatgctactcaacatccaagcagtagttgatttggaacgtttcgtgattggcgggggtatcacagcgcaaccaattgtggtccaaactattcgtgaatcatacgaagaattggtagcgcgccgcccacaagttcgtgacggttttacaacgccggaaattctaccagcccgttttggtaatgatgcaaacttgtttggtgcgttgtaccatttgttgatgcgcgttaatcatgaggattaatgccagttggtatagaccttgaattagaagtttagtcggaatgtcgggcttcagtatgataaaatattcacgagataagtttttgagactgtgagccgacatcatgaaaaggacaacagtaaaatgacgattacagtaaatgatttgggcacaatgcctaacggtgaagttgtaaagcaagtggttattgagaatgctaatggccacaagcttggtttggtttcttggggagcctcatggcaattcttgcaaactaaggctggtgatgaactagttttggcttacaaggacgcacaaggctactgggaccacgcttacttcttgggtaacgcgattggccgtgtggctggtcgtattgacggtgcttcatttgagttgaacggtaagacggtcaatttgaaggccaatgaaggtaagaacgctttgcacggtggtgaagacaactttgcaacgcgtaactgggacttcacggttgatgaggccgctggttcagtgacgtttacgacaacgatgacggaagctgatgataacttccctggtacaatgccaacatcattgacgtacacattcacggacgacgatgaagtacgtttggacttctcagctgagtctgacgaagacacgttgtacaacccaacaagccacgtatacttcaacccagccgggattgatacggatgcgcgtgagttgacgttgcaattgaagtcaccacgtcacttggaattccgtgaggatcaaattcctacgggtaagttgttggagacggctggtacgccattcgacttccaaacaccggctaagattggtgacaagattgctgagatgaacggtgcatatgatgctaagtttgacgatgcttttgagttggtttacgaagctggtacaccatcagcaatcgtgacggacgagaagtcaggtcgtgcaattgaaatgacgactgaccgtaatgcagttatcttcttcatcacgaacccagctgttgctgaccacgaaggtgatttggattggttcgaagctaacccatacaacgcggtggccttggaagcgcaaacgttgtcagatgctattcaccaccctgagtttggtgatattgtcttgccagccggcgagaagcgttcatacacaacgacatacgcatttaagaatttgtaatccacataacgggcattcgtttgacgggtgcccgttattttttacgtctaaagattatttggcgaaacgttcaaaaacaaacaggcgatattgccgaaaccgctttcaagattttttgggaagtggtataattggtctataccaaaagttattaatggggaatgaggtaatttacaatgacgacattgaagtttgatacatcaaagttagcccaattcgttggggagcaagagttagctatgatgcaaccaatggttacggttgcggatgaaatgctacgtaagggaactggggctggatcagcctacactgactggcttcacttgccaactgaatacgacaaggatgagtttgcccgtattcaagcagcagcaaagaaaatccaatcagactcaaaggttttggttgttattggaatcgggggttcatacttgggtgcccgtgcggcaattgatttcttgaatgaatacttcaacaactacttgccagatgagcaacgcgacttcccacaagttttgtttgccggaaactcaattgcgccggcttacttgaacagtttgatcaaggttatcggcgaacgcgatttctcagttaacgtgatttcaaagtcaggtacgacgactgagccagcgattgcattccgtgtattcaagcaaatgctggaagaaaagtatggtgttgaaggagctcgcgagcgcatctacgccacgactgacgcaaagcgtggtgctttgaagacgttggctgacacggaaggctacgaagagtttgttgtgcctgatggtgttggtggtcgcttctcagttttgacggctgttggtttgttgccaatcgcgactgctggtggtgacattgaacaattgatggctggagcagcagctggtgaagctgaatacgctgatgctgatttgacgaagaacccagcttaccaatatgcggcttaccgtaacatcttgtaccgcaagggttatacaacagaattgttgattaactacgatccaacattggtacaatttggtgaatggtggaagcaattgcaaggtgagtcagaaggtaaggatggcaagggtatcttcccagctaccggaaacttctcaacggacttgcacagtttcggacaatacatccaagatggtcgtcgcaacttgtttgagacgttgttccgtgtaactgagccagtaacggacgttgtgattccagaaatggacgctgatgacggtttgggttacttgcaaggcgagaagatgagctacgttaaccgtacggcttcagaaggaacgttgttggcccacgttgacggtggtgtacctaacatgatcgttgagttggacaagcaaaacgaatttgctttgggacaagctatctacttctttgaggtagctgttgccattgctggttacttgaatggtattaacccatttgaccaaccaggtgttgaggcctacaagcgcaacatgtttggtttgttgggtaagccaggctacgaagagttgacggctgaattgaaggcacgtttgtaagatagaagttaatgacggagaactgcagttgtggttcttcgttttttgtttagggcggaaactaagcgcaacacaacatttttccgaacaaaaaagcacgcaatactagtttttagacaaaaactctgctaatataattcagaaagacataaatctaggagaattcaatcatggcaactattggtatgaatgacttgaagactggtttgacgatcgagtacaaccaatcaatctggcgcgtgttggagttccaacacgttaagcctggtaagggagcagcctttgtgcgttcaaagttgaagaacttgcgtacgggtgctgttaacgaaatcactttccgtcctggtgacaagtttgaaactgcaaacatcgagacgactgaaatgcaatacttgtatgctgaaggtgaccaacacgtcttcatggacaacgaaacttacgaacaagtttcaattcctgatgacaagatccaagacgctttgaagttcttgttggaaaacatgaacgttaagatcactacttacgagggtgaaatcttggacgttgaattgccaaagactgttgagttgactgttaaggaaacgcaaccaggtatcaagggagctactgctaacggtggtggtaaacctgcaacgatggaaactggattggttatcactgttcctgacttcatcaacgaaggtgacaagttggttgttaacactgacaacggtggatcatacacgtcacgtgcctagtttttacaagtaaaatcaggtataataaatatactgttgaaagcgccgaccggcagccggccggcgctttcattttgaaggaggaaagttccatggcagaagaaaccattatattgacgcacccaagcgatatttcaggcgaaacacgtgttaacgtacgtgttcttgaaatcattgctgggcttgcagcccaagaagttgagggtgttgctcgcttgcgtggttcattctcagaacgtgctcaagaagcattcggtcgccgtgttcacggaaagggtgttgaattgaagcaaggcgaggatggattggaagtcgacgtatacgtttacttgaactacggtgttagcgtacctaaggttgcccacgcaatccaagaacgtgtaacgtcacaagttgctgcaatgactgaattgcaagtaacgatggtaaacgtgcacatccaaggtgttgtttcaacgaagccaacgttgactgttgatccaaacaacttgtttggtgatgacaatgagacggaaggaactgaagaataatggcaacattgaaccgacaccaattgcgacaagccgcattccaatctgtatttggattggcaatgaatcctgatgcggaagtcgaggcagttgtccaacaagtacttgatggtgatccagaaattacttgggaagacgaattgccaacggacttgttggacatggttaatggcatcattgaccaccaagatgagttcgacttgacgatttcagaacacttggctgatggttggacgcttgatcgtctaaacttggccgacatcgtattgatgcgtttggcattgtatgaagtaaagtacactgaaacgccagccaagattgccgttaacgaggccctacaattggctcacgactttacggatgattcatcacgaaagtttattaacggaattttgaacaaagccttgactcttggagaataaggttatatactgtttaactgttagagaaataaagtaacagcgaccccgttgttcaccttgatgagtttacctcatcgggtaaatcactcattattgattgatgatgaatggcgggttatcgtgtgtcgcgataatccgcttttactttatttcaagttttttcggaggtaaggaccatagcaaacgcgcgccaaccacaacaacaacaagatttaattaatgatcgcattcgagctcgtgaagttcgcttgatcaccgatgacggtgaccaaggaattatgcctaaggcggaagcgcaagcaatcgccgacgagcaagagttggatttggtattggttcaagctaatgccaagccaccagttgctaagattatggattacggaaagttccgtttcgatagtcaaaagaagcaacgcgaacaacgtaagaaccaaaaaatcgtcagcatcaaggaagttcgcttgagcccaacgattgatgacaacgactttaacaccaagaagaagaacgctgttaagttcttggagaagggtaacaaggtcaaggtttcaatccgtttccgcggtcgtgctatcacgcacaaggaaatcgggcgtgaagtgatggaccgatttgcaactgatctagaggagattgcaaaagttgaatctagagcaaagatggaagggcgcagcatgtttatggtgcttgcacccaaggaaactaagtaattaaaccaagtttggaggacatatcaatgcctaagtttaagacacaccgcgcttcagcaaagcgtttcaagaagactgctaacggtggtttgaagtcaggtaacgcctttacgtcacaccgtttccacggtaagactaagaagcaacgccgtcaactacgtggaacttcaatgatgaacaacacgacgttgaagacttacgttcacatgttgagccgttaatttgaagttttaactttaaattattcatcggttctgaattagaaattatagaaattactggaggaaatacccatgcgagttaagggtggtactgttacgcgcgcacgtcgcaagaagatgatcaagttggccaagggttaccgtggtcaacgtcacatcaactacaaggttgctaagcaacaagtttggaagtcatggttctatgcattccgtgaccgtaagcaaacgaagcgcaacttccgtaagttgtggattgcacgtattaacgctgcagcacgtatgaacggattgtcatactcacgtttcatgaacggtttgtcattgatgggttcaactttgaaccgtaagatgttggcagacttggctgtttctgacttcgaagctttctcagctttggcagacgcagctaagaaggctttggcagacaacggtcaagttgttcgcgaagcttcagcagctacttcagaaaagggtgttaagattaacgccgctgctcctaaggctgctaagaaggttgcttcatcagagaagccttcagacaagaacactgttgctgaaatcaaggcttacttgtcagctaacggtatcgacttcccagcttctgcaaagaaggctgagttgttggcattggtttaatgcttagtaaaacgcactttgaactttagggttcgaggtgcgtttttttgtttgcatgggtgaagcaagatttggacagctaagtgtgatacgataatggcgaataagtatagggggaatactttatgggacaaccagttattctagaagcggcttactttgacgccgtgtatgagctttgtcggtatgcatttcataaggagccacgtgggggacgtgacgctttagcagaatttttcaagcaaacaaccgtatatggagaatttgatgacaataatcaattgaccagccaagtaacccggattccgtttagtgtccgtcttgggcaccgggaaattgccggtaacggtatcggcaatgtggctagttatcccgaataccgaggtaacggggctgcatcgcggctaatgatgcaatcactgcaagattcgtatgatgcaggtgaggtgataagttacttagcgccgttttcgtatgggttctatggtcgttttggttatgcccaggtttttgatcatgcagatatcacatggcgtgcagatgattttccacaaggtaagcgaacacctggtgttgtggaaagattaccgtttgagcgagcgctcgagccaatgaaacttgtctatcgacaggcagatgtcttcaattacggggcaattgctcgcgaggactggtggtggcgctattacttcagcatgaaaacgccacagacgaagttcgctatctatcgagatgaagagggtgtggcgcaaggttatgtcatgtatgagttcagcgagatgacattcgttattcgtgagtgggtcgtactaaccacggaagctttactaggcctgactcgcttcattggcagccatgcggggtcgtttgaagtgtttacttacgaggcaccaacagctgacgtcacagcagtgccggttgcacaattgatgaccgaacctaaatatcaagcggtcgttaagccgtatatgcaagcgcgtattgtgaacttggaagcgttgtgccaagttctggagctggatgtgccggagacggttgcgtttgatgttcaagatgaaactgcgccgtggaatggtggacgctttgaactacgtggcggcacattagaacgtgttgttcaaactgaggcaccgcaattgtcgggtagcattcaagcattcacacaatggttgctggggtacaaacgattgtctagtttgctattgaccggcgagttgcgaacgaacacaccagaagaatttgaaccggtggacgcattattaacacgtcaacaccccgtattggcggattacttctaacagcaggaaaccaacggttaaggctggtaagaagggtaatggcttagttggctgccacaaactaatgggtaaatgaaggccacagctgattgtgagccataaaggtagttgatctggtgataaatgaagagcaccaacaaaaataacatctagatcaccattgccgagaaacttttcacggtaatggtgatttattattaaggcacaaacatagataataaatgcagtaaccggatgcgaatcatgatgtgtaacacccaataagaatgctggggctaataatcttgaatcgattagacactgtttcaaatcttgaacagttagtgaacaaagtgcgataataaagggcaggtcgtagatcgacattgataatcctctattgttttatagtaagaaagagcttgaaaacagcggattttccaaaaatgacacgcccggaattgtttgcaaactgaatgcctatatataggcatttttaattggtaaaaagggttgcataatcgtgaatgcagtgttatattattacttgtgcttttagtgagcagggtgtttgcgtgttacgcgacgtgctgaactcgtgaacgagaagtaccattcagctacgttttcagattggttattaaatgacacgcctggaaatgtggactacacactatatagaaaattgaaaggggactcttagacatgcctactattaaccaattggttcgtaagcctcgtaagtcaaagagcacgaagtcaaagtcaccagctttgaacttcggttacaactcacaatcaaagaagacgactaacgtttcttcaccacaaaagcgcggtgttgcaactcgtgtcggaacgatgactcctaagaagcctaactcagctttgcgtaagtacgcccgtgtgcgtctttcaaacttgatcgaagttacggcatacattcctggaatcggccacaacttgcaagaacactcagttgttttgatccgtggtggacgtgtaaaggacttgcctggagttcgttaccacatcatccgtggtgctttggatactgccggtgttgacggtcgtatgcaatcacgttcaaagtacggcgcaaagcgtcctaagaagaagtaattaagggaggacattaataatgccacgtaagggttacactaagcaggctgaagttctgcctgatccaatttacaactcaaagcttgtttcacgtttgatcaaccgtttgatgcttgatggaaagcgcggaactgcttcaactatcttgtacgaagcttttgatcgtatcaaggaagctactggtcaagagccattggctgtgttcgaagaagctttgaacaacatcatgcctgtattggaagttaaggctcgccgtatcggtggatctaactaccaagttcctgtcgaagttcgtccagaacgtcgtgtaacgttgggattgcgctggttggtgcaatactcacgcgctcgcggtgagcacacgatggatgagcgtttggctaaggaaatcatggatgctgccaacaacactggtgcatctgttaagaagcgtgaagacacgcacaagatggctgaagccaaccgtgccttcgcacactaccgttggtaataaccaattgatggctacagtctgtgaagactatagccattttttgcgaatatacggtataatagtactaacgcattaacattgtgttggatgtaatagaatttcaaggagaaatactcatggctaacaagcgtgaatacccattgctacgtactcgtaacattggtatcatggcgcacatcgacgccggtaagacgacgacgactgagcgtattttgtactacactggtaagatccacaagattggtgagactcacgacggagcttcacaaatggacttcatggagcaagaaaaggaacgtggaatcacgatccaatctgctgccacgactgctgtttggcgtggattccacgaccaatacgacaaggaaccattccgtgttaacatcatcgacactccaggacacgtggacttcactatcgaagttgagcgttcattgcgtgttcttgacggagccgtagccgttcttgacggtgctgccggtgttgagccacaaactgaaactgtttggcgtcaagccgagacgtacgaagtacctcgtatcgtctttgttaacaagatggacaagatgggtgctgacttccaaatgtcagttgactcattgaagtcacgtttggacgctaacgcacaggctgttcaatggccaatcggtgccgaagatgactttgaggccatcatcgacttgatcgaaaaggttgctttgtacccaatcgatgatttgggtgagaagtgggagaagcgcgaaatccctgctgactacgctgaattggccgaagagaagtacaacgaattggttgaagccatcgctgatgttgatgacgaaatcatggacaagtacttgggcggagaagagatttcagaagctgaattgaaggctgctatccgtcgtgcaacgatttcattgcaattctacccagttcttgcaggttctgcctacaaggataagggtgtgcaaatgatgcttgacgcggttgttgactacttgccatcaccattggatgttaagccttatgttgctacggacccagatactgacgaagaagttgacttgattgccgacgatgacaagccatttgcggctttggcatttaaggttatgacggacccattcgttggtcgtttgactttcgttcgtgtttacactggtactttggagtcaggttcatacgttttgaacacgtctaagggaaagcgtgagcgtgttggtcgtttgctacaaatgcacgctacgaaccgtactgaaatcgaagaagtgttctcaggtgatatcgctgctttgatcggtttgaaggatacgactactggtgactcattgactgctacggatcacccattgatcttggagtcaatggagttccctgacccagttatccaattggctatcgagccaaagacgaaggctgaccaagacaagatgtcaactgctttgcaaaagttggctgaagaagacccatcattccgtgctgagacgaacccagaaactggtgacacgttgatctcaggaatgggtgagttgcacttggacatcatcgttgaccgtttgcgtcgtgaatttaacgttgaagctactgttggtgcgccacaagttgcttaccgtgaagcatttacgcaaactgttcaagcccgtggttactttaagcgccaatcaggtggtaagggacaatacggtgacgtttggattgaattctcaccaaacgaagaaggtgctggattcgagtttgaagatgccatcgttggtggtgtggttcctcgtgaatacatcccttcagttgaagctggtttgaaggactcattgaacaatggtcctttggctggattcccattggttgacttgaaggctaagttgtacgatggttcataccacgatgtcgactcatcagaagctgcctttaagattgccgcatcattggctttgaaggaagctgcaaagactgctggtgccgttatcttggagccaatcatgaaggttgacatcgttgttcctgaggataacttgggagatgcaatgggtcacgtttcagcccgtcgtggtttgttggaaggacaagagcaacgtggtaactcaatgatgatccacgctaaggttcctctatcagaaatgttcggatatgcaacgactttgcgttcagctacgcaaggacgtggaacgttccaaatggcattcgatcactacgaagctgttcctaagaacgtgcaagatgacatcatctcaaagtacggtaagggttcagacgctgagtaatttttaattacaaacgactgcttacaatattaagatgaaaattaaggatgaagataattcgtaagagttatcttcatccttttttgttttagactgttaaaatatgaccataaggatgggggagtagtgtatgaataagaagattgtcgtaggcggtgttatcgttgcagccgtggtggcgggtggtgttggatatggcgtgacacatactgctaaagcacaatttgcgtcacacatgctgagcatgtttaagtcggacgataacgtctataaattcagtgtaaattcgactgacaaaaccgatatgcgtgtctctggtaaagttctgcaagacgcaaagaagacggccaatatcgcacttacggctgatgtgacaacggatggtcagactgcgacgtatgatttaaagaagaatgccaagcatacgtatgtctcagctggtttcttaggtgatgtcatgaagatggatggtgcaacggacattcctgagttggcgaaagtgcttaagaatacctggttagaaaccgataataagtcttacagtaaggttgaacccgaagctgttaaaaaagatgcacaaaccatgacgaagtggttcacggacttggatgggaaaaagttcaaaaaggtgacggatggttatcaagtcacattgaagaaggccgattataagagttttgtgggagcattgaagaaaacggaaactgctaagacaatgaagattaaggcggagacttggaaagacatcacagcatcaattgatgacctggaaaaccctaaattgactattaccatggcagataaagggcaccaagtcaaagtagcgtcagaagcgttagttgcaggtaaaaagactgctttcaaagcgcaattgacaacgacgcgtaatgataatcaatctgttaagatgccaacttctgaagagataaagacccagaaggaattcaccaacattatcacagcggtgattatgcaatacgctttccaacagatgggatctgacactgattattagactagtaagcaccggcatctcgctggtgctttttacttcatggcgtttacagaacgattaagtggaatggaaaagtgatacaaatttccttatttttggtaaaattaagcttatgtaaagaaaggtggtactcagtaattggcacaacccattattgaatttaagcatgtggctaagcaatacgatgatacagtcgtattgaagtctgtcgatttagaaatcgaagcaggaaagttttacactttattgggcccttcaggatcaggtaagacaacgattttgcgtttgattgccggtttcttggaggcgtcatcaggtgacatcctgtttgaaggggaacgtattaatgatgttccagctgaaaagcgccgtgtaaatacggttttccagaactacgcattgttcccaaatatgaacgtatttgagaacgtcgcctttggaatgtctattaagggaaagccaaagaatgaaattaaggcgaaggtcgctgaaatgcttgaattggtcaagttgggtggctatgaggaccgtgaaatttcagagctttctggtggtcaacaacaacgtgttgcgattgcacgcgcgttggctaacgacccagaagtcttgttgctagacgaaccattgtcagcattggactacaagttgcgtaaggatatgcaatacgaattgcgtgaaatccaaaagcgtttgggcattacatttatcttcgttacccacgatcaagaagaagcgttggcgatgtctgactggatttttgtgacgaacgaaggtgaaattgttcaaaacggtacgccagttgatatctatgatgaaccaatcaaccacttcgttgcggactttattggtgaatcaaacatcgtgcctggtgtgatgcgtgaggactacttggtttcatttgccggtaaggaatttgaaaacgtcgatggtggtatgcgtcctaacgaacaagttgaagttgttttgcgaccggaagatttggacttggtgtctgaagaagaaggtaagttggtcgtaacgattgatgaccaatcattccgtggtgattactacgaaattacggcttacgatgatgaccaaaacgagtggcaaattcaagcgacgaacccatctgttatcggtgaacgtcgtggtttgtactttgacccagaagatattcacatcatgcgtttgaacgaatctgaagaagacttcgatgctcgtttggagcaatatgaggatactgaagaggaagaaggagctgcaaatgaagaataagggaacaatcagctacacggttccgtactacttgtggctcgttctctttgtcattgcgccagttgtcctattggttatccaatcatttggaaacatttatggacacttcacgttcgacaattatgcgacctactttagttcagggacgtatcttcgtatgacgtttaactcggtattttttgccttcgttgtgacggcaattaccttgttgatttcatacccaatggcttacattatgagccgtttgaagaacgcacaattgtggctgttacttgttattttgcctacatgggtcaacctattgcttaaggcatatgcatttattgggctattttctaagacaggaacagtgaataacttcctaagctttattggtatcggcccacaccaaatcatgtttacagatgcatcgtttatgattgttgcggcgtacattgaaattccattcatgattatgccaattttcaattcgttggttgaattggatcgcagcttgattaatgcggcccgtgatttgggtgcgacaccatggcaaacgttgacgaaggtcattattccaatgtcaatgggcggtgtgaaggctggtattcaagcggtcttcattccaacgctatcactattcatgattacccgtttgattggtggaaaccgcgtcattacgcttggtactgccattgaagagcacttcttggtgacacaaaactggggaatgggttcaacaatcggagtgattttgattatcgccatggcagcaacaatgttctttacgcgtgatcgtaagaagaagggaggccgtcgtggataataagccaaaaaagtggtcatacatttacttggtgtttgtcttcatcttgatgtatgcaccaatcttctatttgattttctattcattcaacaagggtgattacatgagtggctttgaaggcttctcattgcgtcactacggcgacatgtttgctgatacacgcttgatggaaatcttggttaatacgttcatcgtggcattgctatcatctgtgattgcaacgctaatcggaacgttcggtgccttgggtgtatacaacacgaagcgtcgtggaacaaaaaatttgttgctatcattgaataacgtgttgatggtttcaccggacgttatcattggtgccagtttcttgattttcttcacgatgattggcatgagtctcggctttgggtcagttgtgttgtcacacatcgcattctcaattccgattgttgtgttgatggtcttgccacgtttgaacgaaatgaacccagcgttgattgacgcggcccgtgacttgggtgcgtctaactatcaagtgttgtcacgtgttgttttgccatatgcttggcctggtattttggctgggttcttcatggccatcacgtattcacttgatgatttcgcggtaacgttcttcgttactggaaacggattctcaacgttgtcagttgaaatttactcacgtgcacgtcaaggaattgacttgtcaattaacgccttgtcagccttgatgttcttgttgtctttgcttttggtcacaatctattacttcatttcaaactacagtatgaagtcaagtaagaagaagcgtggcggtgcagcgggaatggtggtacatcaataatgaagagattagcatggttaaccgggattattctggccgcagtcgctttgttatttggtatcaacctagcattgcaaaagtcggctgagtctggcttgaagtcaggcgctaataagaccctaacgatttacaattggggagattacatcgacccaactttgattaagaagttccaaaatgagactggttacaaagtggattatgagacattcgactcaaatgaagcgatgtttactaagattcaacaaggtggaacacactatgatttggcggttccgtcagattacatgattcagaagatgaagaaggccaacatgttggttaagcttgatcacagtaagttgactggcttgaacaattacgatgaccgttttatggatcaaccgtttgatcgtggtaacgagtactcagtgccttatttctggggaacgctgggaattgtttacaacgacaagtacgttaagccaggagaaattaagacctggaatgacctatggaacccacgtttcaagaattcaatcatgttgattgattcttctcgtgacatcatgggaatgacgttggcatcaagtggtaactcagttaacacgaagaacattccggaattggctgcggccaagggaaagcttgaaacattgatgccaaacgttaaggcgattgttgccgacgaaatcaagatgtacatggcccaagatgaggctgccttggcagttgattactcaggtgatgctgcggaaatgatttctgaaaacagtcacctgcactatgtggtgccatctgatggtggtaacatgtggttcgataatatcgttatgcctaagacggtgaagaataagaaagcagcttatgcattcattaacttcatgagcaagcctgaaaacgcagcaaagaatgctgaatatgttggttatgcgacgcctaacaagaaggctaaggctttgttgccaaagtcacttcgtaacgataagcaatggtatccagatgcgaagacattgtcacatttggaagtttaccaagaccttggcccatactgggttggtcaatataacgattacttcttggaattcaagatgacaaaccgttaagcgatgagggtcggtgcagtaatgcaccggcttttttgcatgcagtcacaaaatatttacagttattctaaggaaagacacgtataatggagtggttaagttgatttttaaatcaggggagaagtaagtctaatgaaaaagtttcgaccagaagtgctgattgcagtcattgcggtagtggttgtcgcaggagccatggtatttgcagcaatgtctgctaagtcaggggatgcacaacaaagctcttcatcaagtgcagcgtcatcttcaactttgtctaaggcgaagttggataagttgacgttgccacaattgtcagacaaggttgccgagaacgagagtgaagttgtcatgcacacgtcaatgggtgacatcacgattaagttgttcaacaagtatgcgccattggccgttgagaactttgtgacgcacgccaaggatgggtactacaacaacacaaccttccaccgtgtcatcaaggactttatgattcaaggtggtgatcctaagggggatggtactggtggtgagtcaatctggaatggtaaggattctaagattgatagcggtaatggtttcaagaatgaaatcagcccatctttgtacaacatccgtggtgcgcttgcgatggcgaatgctggtgctgatacaaacggttcacaattctttattaaccaaaattcagatgatgtgacaagcaagattagtgcgaagcgttacccagagaagatttatgacgcatacaagaagggtggaaacccaacgttggatggctcatacacggtctttggtcaagttatttcaggtatggacgtcgtcgacaagattgcgtcagtcgcaactgatgacaacgataagccaacggagacggtgacggtaacgtcagttgaagtggtgaaggatgcttcaagcaagtaaagccaaaaagaaaagcacacgctcagagagcgtgtgctttttgttagtgcgctgtttcttcctcttgcacttcatgggcttgtgcagtgttgttaacaagcaattggaagtagttatcaaatccaggcttgtcataactttgcatcaaagcaatgaagtcaacagtagaccattcactgacaacaatggcaccatcattgtactgcaaactgcgtgcaattgatgatgtgttctcaactagatagaaggtctcatttgtatctaggtacaacaactgcaacttgatgttacggttggcacctagggcggccttcgcagctaggaatggatctgaaacgaaacgttgactaacgttctcgtgacgaaacttgtgaatcgtctccaacgtgttaccaataatcttcatagcgagttcctcgactttatcgaataataaattagaatgataaaaattactcttttctaataacattttaataaaacgttgataagcattataataccaccatatatcgaatacgactagatggttttgtgtattaaaaatgaaagccaccaacctgcgagtttggttggtggcaatatcgaattattgaatgatcaaaacgtcagtcttagcgttttgaacaacgaatgaggcaactgaaccaaccaacaaacgctccaaagtgttcaaacctgactttccaagcataatcaattcgtttccgtgatcagcggggaagtcgcgagcgataaccgtcttaggtgaaccgaaacgaacgtggatgttaacatccttagcaccttcgttttgagcaagttcttggtacttagccaacttttcttcggcgtcttgtaccaattggtagacaacgtcacctgaaattgacataccagccaaacctgacaatgagtttgtgtcgattacgtacaacaagtccaatgaagtctcgttacgtacagcaacggcagcggccttttcaaccaacttttctgaaatctttgatccgtcgactggggccaaaatgttcttgtagttaatgctttctgcagccatggcgatttaccatccttttttaatcgatttagacaacatttgtatgtgtccctttgatataaattattatatacccaatgatacaagaatgtaagcggtttctgttagacgattaatcgagaaaataatgagcgtcgaaccggactttatgacgtttttgttttaaatgttactaaattatgtcagcggtgaaaaaacaggttcttaacttgcttcccaaatgatagccatgtataatacttgttatgcgatgagtcgagaagatcacgttagatctttgataaacggccctcattaacagccgcattgctggagggtgagatagggagttgtggaactcgcttctctgcacatgactaacttcgagttcgctcgttggtgtacgttgactgatgggtaaccatcacgtgagctagagcacgtcaattctagcattgccaagcggaaaacgtcggtcttcggaccggcgttttttgcatattaagacataaagctacgacttaaccatatgatgtactataataagtatgttgttaatattcgataaaaggggatatcgattatggaaaagttaatacaaattcgagttgaagaagaaatccgtaatggcgctgatgaggtgtttcgtcaagaaggactaacaacgcaacaagcggtcaaaatgtttttaacgcaagtggccaataatggtgagtcaccatttcatgatctctttaagccgaaagcataatatgacaaacgtcccagcaaaaagcgtgggacgtttattttttcttcataccgcgagtacaataggtttgctataataaaacagaagaaactagggggatgaatatgcaaacaataacatttcgacgtttctcttttttgcaacgattgctgattaataccattatgttattagctctcgctggtttgtttaagcaagggctctatattagcaacttgttcacggcagttttggcggcgcttattttaggtgtcctgaatgccttggtgaagccagttctccaaattctagcgttgccatttacagtgctaacgtttggtatttttggtctcattgttaacggaatcgttttgtggatggcatcagcgattgttggggatggattccgttttgcaagttttggttgggcagtctttattgctatcatcatgtcactggtaaacctgattatttcaagttacttcagccgacgagatagcgacatcaataaggaagattaacgatatggcaaagaaaattacagtcaaggatttgcttgataatacacacttgaatttagttgccggtgaagaatatctaaatcgtgaaattacgacagctgatatttctcgtcctggtttggaaatgacgggatacttcaattactacgcaccagagcgtgtgcaattgatgggaattacggaaacgtcattcgcacaccgcatgaaccacgatgaattgttgatggttgcacgtaagatgatgcaacctaatacaccggcgtttgttgtttcaacaggacgtcagttgccacaagaatttatgcaagcagcgcttgaagcacaaattccagtgttggcgacagaattgacgtcatcacgtatcttgtcaaacatgactttcttcttgagtggtggtttggcagaacgccaatcagttcacggtgttttggttgacatcttcggtttgggtgttttgattaccggtgattctggtgttggtaagtcggaaacggcgcttgaacttgtgcaacgtggtcaccgtttgattgcggatgaccgtgttgatgtgtacgcccaagacgaggagcgtttggttggtgagccacctgccattttgcgtaacttgatggagttgcgtggtgtgggaatcatcgatgtgatgaacttgtacggtgctggtgctgtgcgctctcatgcaacgattgcctttaacttgcacttggctaagtggacggatgatcaaaaggttgaccgtttgggaaatggtgaggaaacgatccaaattcaaggcgttgatttgccgcgctttgttttgccagttcaaactggacgaaacttggctgttttgattgaaacggcagctaagaatttccgtgccaagaagatgggatttgatgcaactgaaacgtttaatgataatttgaacaagttgattgctgaaaattcagaaaattaatgatttcattaaggaaaagccccaactgtcgggctttttcacttttatgcattttcaaaatttgtgaatatggtattatagagtatgttaactttggcttgagaccaaagttaacgcaaggaggaacattgtgagcaatgaagtaattgcagtgttaggtgcaggatcttggggaactgccttagcaaatgttgctgctgagaatggacatgatgttcgtctttggacatataagcccgctcaagtggcagaaatcaatgaacaacaccgaaatagtcagtaccttggcaataaccctttgcatgaaggtgttgttgccacggccgatatgaccgaagcggtacgcgatgcgacaatcgtcttgagtgtggtgcctactaaggcaacacgcgaggttgcacatcaattgtcagacgtgttgtcagctttggaccaacaagttgtgttggtcgctgcaacgaaaggcttggagccaggcacttacaagcgtgcatcagagatgcttgctgaagaagtggctgattcacagcgcttgggcttgggaattatctcaggaccatctcacgcggaaggggttatcaagcatgacccaacgctagtaacggctgtaagcgaaaacttggcaactgctgagcgtgtgcaagctgcctttacgaatagcgtattccgtgtgtacacaaacacagatttgattggtgctgaatttggtgctgcattaaagaacgttattgcaatcggtgcgggcgcactcgagagcttgggctttgatgcaaacgccaaggcgggattgtttacacgtggtttggctgaaatcagccgcctcggacaagcattcggtgcaaacccactaacattcatgggcttgtctggtgtcggtgacttgtttgtcacggccacttcagtacactcacgtaattaccgtgccggtgtacaacttggagaaggcaagaagctcgatgacatcgtcgaaaacatggggatggtcatcgaaggaatttcaacaaccaaggtcgctcatgaacttgcgcttaagaagcacgttgaaatgccaattacatctacaatttatcgtgtcttgtacgaaggtcaagatatcaaggaggccatcaacgaattgatgggtcgtccagtttcacaagaagggaagtaacacactatgaagccagtacgtaaggctattatcccagcagcaggtttgggaactcgtttcttgccagcaactaaggccttggccaaggaaatgttgccaatcgttgataagccaacgattcaatttatcatcgaagaagctttggcatcaggtatcgaagacatcgttatcgttgatggaaagtcaaagcgttcaatcgaggaccactttgattcaaaccctgagttggaaaacaacttgaaggaaaagggtaaggacgaattgttgaagttggttgaagagacgactgacattaacttgtacttcatccgtcaatcacacccacgtggattgggagatgccgttttgactgctaagtcatttatcggtgacgagccattcgttgttatgttgggtgatgacttgatggctgacgagacgccattgactaagcaattgatcgaccgttacaacacgacgggtgagtcaacgcttgctgttatgaaggttcctcacgagcaagtttctgaatatggtgtgattgcacctgaaaaggaagttgaagacggtttgcaccaagttaactcattcgttgagaagccaaagccagaagatgcaccttcagacttggcaatcatcggtcgttacttgttgacgccagaaatcttcgaagagttggagaacacgaagcctggtaagggtaacgaaatccaattgacggacgccattgattcattgaacaagcgtcaacacgtttacgcccacgaatttaagggtaagcgtttcgacattggttcaaagattggtttcttgacgactaacatcgaatacggtttgaaccacccacaaactggcgaagccttgaagcaatacatcaaggatttggcagcaacgttggattaatccgataattattaagagggtagccacacgcagaggctgccctctttttgtcgcagtaggtttggagagaggatttttgaagttggttactttgaagcgtgattttaaggttattgggttatcacttttgtttttagccctattagttattgagtattgcttatcaacggttttcgtctacaaaatgggctttgtaccgttcttaccgttgattcttcacatcgcttgcttttttgtaatcggtgaattgttggcaacgatttactcatttgtgaagcgaatggcgaacgcgtgagaagctataaaatctaggctgttatttgaaaggcagatccattgcagatgggtctgccttttttgctatccgccaattccttattccgggaaaaaggccagagcgtgtactataatacagctatagtccgaaaagtcgggcgaccaatcttacttcccgggggaacgaagagatgaaagattatgaactatatcaagcacgtgataagaaatctagtcaaaagtggctaacccaaggggctgcaattctatcaacggtattggcagcttcttcacccgttctaccaattatccaaatggctggtagtgtatttgcagacgatacagcgcaatcgacaacgaatttagccttaacaaaggcattgcaaaatgaaaactcattggccagcaagtatgccttggtcgcaacgggtagccaaagtgccgcgacaactggtacgacggatgcaactcgtcgtgatttggcagctgctgaatttatgtttagtacgaatccggcggtaacgggcattagcttggtgaacaatcaattggcagtgacggttgccacaggcacacccgttgcgactgtcttagcggtgttgaactacattgaagcatccggttataaggcaattgtgacggcatcgccagttgctacgacgttcacaaataatgccacgcaaaatggtagtcccgtccgtcaatcagtgccactcgcgacaccgattacagaacttgacctaccagcaggtttaattgaagcgctgttggggtcgacgactgccagtggtcagacgttggctgaacaattgcacatcacatcggaagctgattatggcaaggtaacactagcatcattgcgtagcattactgagttgaatttgtcagataatgcggctttgaagcagtggatgggtcaaaagattggtggtgcaacgtacaatccagggcaaaagaatggtgccgagttacgtaacttccaaaatctatttggcatcatgactggtattacgacgctaaatatgtctggtctcatggctggggcctctgatatgtcagtcatcacggcatttatgcaggcgattaatttaccaaagttgactaagctaacgacgttggacttgtcaaataatgcaggggcaattgatgttaattcgttgaatattagctcgtcatcattgacgacgttgaatttggctaacaataacatttctggccttggtcctggatcactttcaaacttgcctaaccttttaaatttgaatttggcaaacaaccacattaactatctaacgtcaggtgtgcaaagtgtgttctaccaactggattcattgaatttggataacaatccgttgaatgataatggtatgaagtggttgcagaaaatcatgacggataaccctgattttgtgttgacgatgaacggtggcagtgcatcatatcaaggcgataatgggcaagcaacgctattacgggacaaactggcgctgattacgtggcacaagaagcccaatctttgcaagacgaatatacgagtttgcagagtggcgtgatgaatgcacttgcttcattggctgataaagctgctaagctagctaagtcagatgatccagctgatcaacaacttgcgcaacaatatgcgacagatatgattgccttgcagcaggtttggcaaatattgcctaatatgacgaatctgaccgaccaagtggctaacttctcgaccattttccatgccaagtcagcgatggatttggtacgtgataagttgaagacggccttggatacagtgacgacggacgataaggaagcccaagagaatgaggctgcatcaagcgaagcccaacaaccaggcagtgaggcgacgaacgatgcagaaatgagtgcagctactgaaaagggggcctcaattgcgcgtgatttaggttcgcttaactccaacttggacttgagttcgtacgagtcggctctttcaagtgttatcgcagtggcatcaagtgctgctaaggctgcgtcatcaattgcaaacgctgattcgcaagcggactatcaagcagatacagcagcaacggcctcagcgttggctgatcgtggtgcatcaagcgcagcgagttatttgtcgaatgccaagagcgatatggctttggcgtcatctgcattgtcagcaggagagtcatatgcggcagctggtaatgcgtcatcagcaaatgatttgtttaattcagcagaaagcttgtacaactcagcggctaatgccatcaagtcagcgagcgcaacgcaatcaacagctgacgaacaattgcgcaatgcctcgagtgcggcttcgttgggatcacaaatggtagacgatgccaacacggtttcattcgtaaatagcattgctacagttgcccaaagttcagcggcggcagcctcaagcttggtgtcatcagctaagtcagtgctgaacgacatgactagcttaagaagtgactatcttggttcactggatgcagcaacagcttcttctttggcaagcattgagtcgcgcgcaagcaaggcaatttcagttgcccagagttatacggatcaagcctcatcggcggccgatgccacgaagagtttagctgccgtgacgttaaatgctggtatgagctacattgataatgtctttggtaacggaaacacgttgaacacatcaagcattgcatccgttgcacgtagtcaaatgacatcagcggcaaacggagccaactctgatgctatcagtacggatagttactacaagcaagcttcttcagcacttgttgtggcaagttcacaagcaagcttggctaactcaatgaagagtagcatcatcaattcgattttggcagcgcagtcaagttcagcggctacatcgaattcggaaaacgcaagtgacggtaccaacctggtgacgccaccgactgaaagttctagtgcagtggtagatgcaccagatagtgatagttcagcaacgagtgagtcgagtgcgacatcagacgcacaaagtgagaacgaatcatcagcggtgacatcagatagtgttgcgacgagtgaaggttcatcagtagccagtgaatcaagcgccgtatcagaatcgtcggcgagtgacgtaacaagctcaagtgatgacactaattcatcagcaaccgtctcagacagtaccgcagcaagtgaatcatctgaagtagcgaatagttcagttgctagtgattcaaatgttgtgtcagactcatcagccagtgacgcaacaagcgaagcatcatctgcagttagtgattctgccgaaagttcagctagttcagcaacgagtgattcggtggcaacgtcagattctcaaggtgaggtgaattcatcagcaactgcatcagacagcgcggctacgagtgagtcttctgaagcggcaaatagttcgattgcgagtgattcaaacgtgacgccagaaacgccagcaagcggatctgatagtggtgcagcaagcgaaggatcatcagcgtcaagtgatgtatcggaaagctcagcaagttcagtaacgggtgactcaaatgcaacgtcagagtcacaaggtgaggtaaatacttcagtggctacctctgatagtggcgtcacaggtgaagtttcatcagtggcaagcgattcgaatactatttctgaatcaccagctgaaaatggtccgtcaacaaacacgacagacaacgcgaatacgccgaacacgggagctaatgatggtaccgttgttgcagtagcaaatcctactgcaaccgctaacacgaacacagcaaacgcgacaactagtggtgctgtggccgccttcaatgctgggcaaccagttggtacgtccggcacgacgtcagctgcaacgactacgtctactttagcaactggtacggcatcaaacgtagctagcgatggtacagcaggagcacgagtccgtgatacggttgtgaatggtgatcaaattacatcggcagcacagcgacaagttgcggacacaaacgatacggcatggtattcacgtttgattgcatctattgttggtgtcgtaatgggcttcttcttcttgctattcagtcgtcgtcgcaaggagcgcgaagatgaaagccaagttacggatgaggacagccaattgtttagtgatgttgaacaattgaagtctcaatggcgtgatgaaaacaaggacaataagtaattaacgcaaatggcctagacgaatttcgtttaggttattttttgtaccctttaatttggaacgaaaaccagttagaatagaaacacgaattaaattaaaaaataatgaaagttcgacgagggggagcaatcatggcacaacagtatgacacaattattttaggcgcaggacctggcggcatgacggctgcgacgtacgcttcacgtgcgaacatgtcagtattgatgattgaccgtggtatttacggtggtcaaatgaacaacacggcggaaatcgaaaactacccaggttttccttcaattttgggacctgagttggcggagaagatgtacgcatcatcaacgcaatttggtgctgagtatgcctttggtacagtgcttcatgtcgaagcacaagcagatggtagctggcgcgttgtaacggacatggacgaatacagtgctaacacggtgattgttgctactggtgccgcctacaagaagcttgatgtgccaggagaagaagccttcgctggtcgcggtgtttcttactgtgcggtgtgtgatggggcgttcttccgtggccaacacgtgattgttgtcggtggtggtgattcagccgtcgaagaagcaacgtacttggctggcttggctgatcacgtgacgattgttcaccgtcgtgataagttgcgtgcccaacaaattttgcaagaccgtgctttcgctaatgaaaagatttcatttgtttggaactctgaagtcgaagaaattttgggtgacgacaagaaggtaacgggtgtccgcgttcgcaataatcaaaccgacgaaacgtcagagattgatgcggcaggtgtctttatctacgtaggcttgttgccagtttctgacccagtgcaagatttgggtattacggatgccaatggttggattatgacgaatgaccgcatggaaacgtcacaaccgggaatctttgccattggggatgttcgtgaaaaggaactccgccaaattacaacggcggttggggatgcagcggttgctggtcaaaacgccttttcatacaacgaaaactttaagatgcgtgcatctgaagtaactgaataatgagatagctaacaagaatcaatcgtttgtgcggttggctctttattagtaattcctaatttattaccaaaatgtcagaagatagcgtaaaatatacaagagcgtttttgctgatacgaaagaaaggggtccacacatgacgcaaggaactaagattattgcctcatctcactacgttccaagtgatatcatcacgaacgatgacttggcggcaatcatggatacgaacgacgagtggattcaagcacacacgggtatcaaggaacgacgtatctcattgcaaggtgagaatacgtctgatttggccacgcaagcagctcgcatggcgttggcacaaaccgacttgaaccctgaagatattgaattgattattgtgacgacgtttacgccagatggtcttgcaccatcaacggcggcgttggtacaacgtaatttgaaagccgaaggggcttgggcatacgacatttcaactgcgtgctcaggatttgtctttggtatgagtacagccgacaagtttattcgttcaggagtttataagaacgctttggtgatttcagccgaagttaactctaagatgatggacttcacggatcgtacatcaaccgttttctttggtgacggagcggccgcaatggtccttgttgcgactgaagaagacgagggtattgtgaagggcgaagagatgcacacgattggtgatgcagaagtcgttcactcaggacgcattcaaccattgtcacgtattggagctgacaattacccaaagacagatgccttccaccaagaaggacgccaagtctttgaagaagttgtgcgtttgattcctgatcacattaccaatttcttggctgaccgtgatttgacgccaaatgatgttgattacttcatcacccaccaagcgaacttgcgtattatcgaggcaattgctgaggcaattgatcaaccaatggacaagtttgccacgaatattacaaagtacggtaacacgtcttcagctggtattgggattggtttggatgaattgaacaaggcaactgatttgactggaaagcgcgtcttgttgacgggctttggtgccggatttacatacggaagtctgctgcttgaattctagtttgcatataaatgttatggaacatgtgcgttgatgcaacacacatgttcttttttattttgcaaaatgtcaccgtttgcatgaaagtttgttaaaatagtaacagttgatttagaacaggaggggacaaacatgaactatgaagaattactcgaccagttacgtacgggtgaacttgaccagttcgttcttgaagcaaaggattttaaagagttctacgaagtttggcgcaattacccttatcagaatgctattcgtggcatcgcagaccgtggtggtgtcgtaacctatacggctaaaaatactgctgagtagaaccatcgcggtttttagagttcacgaattcttcacgaaaggcttatgaaaaaggtaatgtaagcgcttgcttatatttgttatacctgctagaattaactacataaggttagttgaaagatgttttgaaagcgtttttaactcagctattccgtattaaagaaattatttaatctagaggagattatcaccatggaatcacgcgaatttcacattgtagcagaaactggtatccacgcacgtccagcaactttgttggtacaagcagcttcaaagttttcatcaaacgtaactttgtcataccaaggcaaggacgttaacttgaagtcaatcatgggtgttatgtcattgggtgttggtcaaaacgctgatgttaagatttcagctgaaggtgatgacgaagctgaagcattggctgcaatcgcagacacgatgtcagctgaaggtttgactgactaattttagttaataattaatattttgaacatttactttgagggataagacggcgatggcaaaagaaattaagggaattgcggcatcaaacggtgttgcaattgcaaaagcatacaagctcgttgatcctgatttgtcttttgatactcgtacagtagacgatgttcaagctgagaaggaccgcgtagcagcggcctttttagcatctaagacagatttggagcaaattcgagacaaagcagcgacttcaatggggaaagaagaagctgaagtgtttacggcacacatcatggttttggaagatccagaacttttgggtggtatcactggcaagattgacagtgacagcgtaaacgcggaagccgccttgaaggaaacgacggacatgtacattggtatgtttgaggcaatggctgatgacaatccatacatggcagagcgtgcagcggatattcgtgacgtgacgaagcgtgtcttgagtcacttgttgggtaaggaattgccaaacccagcattgatcaaggaagaagttgtgattgttgcgaaggacatgacaccttcagatacagcacaattggatcgtcaatacgttaagggattcatcaccaacgttggtggacgcacagcgcacgcagctatcatggctcgtacgttggaaatcccagctatcgtaggttcaaaggttgccactgaagaaattcaagatggcgacatggttatcttggatggtcttgacggtgttgcaatcgtcgatccatctgaagaccaaatcacaacataccgtgccaagggtgacaagtatgccgctcaaaaggcagaatgggcaacgttgaagaacgaaaagtctgtatctgctgatggtaaggagttcttggttggtgccaacatcggtacgcctaaggacttggaaggtgttgtggataacggttcagaaggaattggtttgtaccgtacggaattcttgtacatggattcaaaggaattgcctactgaagatgagcaattcgaagcctacaagaaggtccttgaaggtatgaatggtaagccagttacggttcgtacgatggacatcggtggtgacaagtacttgccttacttgccacttcctgaagaggaaaacccattcttgggttaccgtgccatccgtatctcattggatcgtgatgacatcttccgtacgcaattgcgtgccttattgcgtgcatcagtttacggtgatttgtggattatgttcccaatggtggcaacattgccagagttccgtgcagcgcgcgatatcttcaacgaagagaaggctaagttgcaagaagctggtgtgccagtagctgatgacattaagttgggaatcatgattgaagtgccagctgcagccgtattggctgacaagttcgcccaagaagttgacttcttctcaatcggaacgaacgacttgatcggttactcaatggccgctgaccgtggaaacgataagatttcatacttgtatcaaccatacaacccatcaattttgcgtttgatcaagaacgtaattgattcagcacacaagtacggcaagtttgctgcaatgtgtggtgaaatggcgggtgacccaattgccgtaccagttttggtcggtatgggcttggatgaattctcaatgtctgcaacgtcagttttgcaaacacgttcattgatgaagcgtttggatacgacgaagatggctgaattggctgacaaggccttggatgctgagacgaacgaagaagttatcaagttggttcaagaagctgttccagctgagtaatgaataagaaaggcgtgcgaccgctcggtggcacgccttttgtaattaaaatttttttgggggaagctatgagcagacgaccaattgtagttggaaactggaaaatgaataaattacccagcgaagcagctgcgtatattagggaagttggcccaatgctagtgcagtacgagggggtcgatactgtgctagctggacaagatgtcctgttggatgcgatggtttacgcagcacgaagcacaccaatctgtattggtgctgaaaacgtgtactgggaagatcgtggtgcctatacaggcgaaactagcccagcggcattagctgatttgggtatcaaaatggtcatcatcggtcactctgaacgacgtaactatttccgggaaactgatgaaatggtgaacttgaaaacgttggcggcgttgcgaaatggcttgatgcctattattgcgattgatgaagcagtgcaactagaatcaagtaacgatcatgctcactggattgttaatcaagtggttgagtcattaaagggtgtgacggaagctgatatggcgaatgttatgttggcatatgaaccaactgctgcaattggttcaggtcaggcgatgagtccagaaattgcgcaaaagagtctgtggatgattcgtcaaacagttgcggacatgtttaatcaagatgtggcagataacctacgtattttgtatggtgggtctgtgaagccaacgaatgtgtatgacatcttgtcacaacctgatattgatggtgtccttgttggggatgcggccttggatgcatcaacgtttattgagttagttagtcttgcacaacaagctaaaagaacgttgcgaaaagacgcataaaagcatcgtagttttgtcgaagttgcccgatatactatcagtgtagagttgataatagtatatgtaatagggggatatcgacacatgtttaagttcatggaaaagattttgtctgatggtagctttgtaaaggtctacctaacgtcaggggagtcattcattttgaatgaaattaacggtgaagcagaaggcatgattttgggatcacacaacgcaggtggtcgcaaggtgcgctatgcggtgaacgaatcagaaatcgcagctgttcgcgaacactggtaaacacaaaagcacgtctcagtaaaatgagacgtgctttttgattgactggattaggatttttcgactgttgaaatatcagtatctggcgtaatttcagaatttgttatatcgtcggccgtacctgaaccgtcttcagtgtttgagctttcagaagtcgtggtgctggataagctagaagatacttctgatgaatctgaagaagtcgagctggttgtagttgtgacagaagagttaccactagttgatgttgcgctgagttctgaagaacttagttgagttgtcgaactaagcgcagattcttgtgtgacgcccgagttgattgttggcgttgcgcttgctgtcgccgaaatgatgctactaggtgtgctagttgcttcaaaaacaggcgtagtatcttctgattgtgccaggatagcgtcttcgtttgattctgcacggacaaagcgacttgttctagccgttgttggattgcttgtttggctatctgtgtttgacatcgagtcaatgtaactagctggctcaaccggattaataccggcagcgattaatttatcgttaaaagattgaatgctagccaatgatgctgaaacgcgttcggactgatgaactggattttgtggcctgtattccggcgaaaaccagctcattgcgtaagaggcgccaaatagataaattggcactgcaatgattagaccaatcaatcctaatattgaaaattttagtttattcataaacgtaacctcctcctcgttggtctgcttatgttatttctacatataagtatacacaacattgcatgacataacagtcggggatgtaacaaacgtaaaacggaatagttgcttcagagtaacgataagcgtttcacagacggttcaaacaaaaagcaagaaagccgattaaatgcaacataacgtgtgaattatgttacaatatatgacaagggatattcccagataactatacttttaaaacaagtaaggagaagacaacatgtctgcaattactgatatttacgcacgcgaagtcttggactcacgtggtaacccaactgttgaagttgaagtttacactgaattgggtggtttcggtcgcggaatcgttccttcaggagcttctactggtgttaacgaagccgttgaattgcgtgacggtgacaagggtcgtttcttgggtaagggaactttgaaggccgttgaaaacgttaacaaggttatcaaggacaagttggttggtatggatgtaactgaccaagttttgttggaccgtacgatgatcgaattggacggaacgccaaacaagggtaagttgggtgccaacgctatccttggtgtttcaatcgccgctgctcgtgcagctgctgatgagttgggaacgcctttgtacaactaccttggtggtttcaactcaaaggttttgcctacgccaatgatgaacgtcgttaacggtggtgcccacgcggacaactctgttgacttccaagagttcatgatcatgccagttggtgcaaagactgttgctgaagctatccgtatgggttcagaaactttccacgcattgcaagcattgttgaaggagtcaggtcactcaactgctgttggtgacgaaggtggatttgcacctaactttgcttcaaacgcagagccattcgagttcttgttgaacgctatcgagcgcgctggttacaagcctggtaaggacatcgcaattgcctttgacgttgcctcatcagaattctacgaccacgagaagaagatctacacgttggcaggtgagcctgataagaaggaatacacgactgacgagttcatcgactacttggagaacttggtaaacaagtaccctgttgtttcaatcgaagaccctctagcagaagctgaggacttgaacgatgaagagcaatgggataactgggtaaagttgactgaccgtttgggcaagaaggttcaattggttggtgacgacttcttcgttacgaacacgaagttcttggctaagggtatcgaaaagggtgccgctaactcaatcttgatcaaggttaaccaaatcggtactttgactgagacgatggaagctatcgaaatggctaaggaagctggttacacggctatcgtttcacaccgttcaggtgaaactgaagacacgacgatcgctgacttggttgttgctacgaacgcaggtcaaatcaagactggttcaatgtcacgtactgaccgtattgcaaagtacaaccaattgatgcgcatcgaagacttgttgactgaaaaggttgctgaatacaagggtatcaacagcttctacaacattgacaagtcagctcgtgaagcaatcgttaactacgtgcgctaatcactagcatctgtcaatttgatagattaattaaagacgaaaccaattcgcaagatttggtttcgtcttttttgttttatgtcgtttttgcttgaaaatgcgtataatattaaaaaatgattagaattcgaaagtagggaacgacatggttgaagtgaaagaaagagatatcgcaacacttgttgcaggcttgcaagaaggtgaattttccagcgtggaattgacagaggcctaccttgaacagattgcgttttttagtacgccaccgtttaacgtcaacgcagtaatcctggttaatccagcagccgttgctgaagcaacagcactcgatgaggaacgccagcgtaatcacgtacgcggtgccttgcacggcatacccattttggtcaaggacaatgttgatgttgcgggtctaccgacaacggcaggtgtattagcattagcggacaatgtggctcccgaggattctgaattggtccaacaattaagggcagctggggcagtcattctgggtaaaaccaacctatcagaatttgctcattttaagtctgatattgaaccgtcaggattttcagttgttggcggtcaaacgattaacgccatctttcctgatttaacgccaagtggttcgagttctgggtctggtgtcgcagcgtcacttagcttggcggcggtaaccattgggacagaaacaaatggatccattttggcgcctgctcaggcgaatagtgtggtagggctaaagccaacagttggggcatggtctgttaaggggattttgccattagcacattcacaagatgcgccaggtccgataggtagaacggttgcagatgttgcgacagtctggcaaacattgggcgggacaacagttgatcacgtgacgaacgtaaccgtattccagcctgccgaaaatgatattgtcgcggaacatgtcgtttcgcaagtagaaacgaagttaaccacctttaattttgcgcgctacacaggagcgctgccagtggctgatggcgccgctgaatatcaacgcttattatttgaatttaaacacgatttcgatgcctatttgcaggaacatggtcgtcagcaatcattgacggatattatcgctttcaatgaggctgatcttgcaactcgtgcaccgtttggtcaaaatttgttggttgaggctgaagcgacatccggtgatttgcaagcaccggcttatcaagaagctgatcgacgagctcgtgactatgcgacaaccagtcttgaacaattactaactgcgagtgatgtggtggtgggtgctgattttagattggtggattacgccgcagtagcagggtatccaagtatcagtgtgccgtttggccaattcggggatataacgtttggcggattggcgagcgtacttgtcgtagcccgtcctaacgaggaagcgaagttgttaacatttgcgcgggcagtcgaagccattggacaacgagttgtgccaagtttaggtgagacatcagagacaatggcctggcaaaaggactaagataaattagagaaaaggtgacacagatgccaacgcactgttcacttttttgactaataaggttttttattttgcatccccaaagcaccggattaggcgacagactatagccataacttattgaaatagatgctacagggaatgcatgacaaaaccacaaaatacaaatacgaaatttacagtcctaaattctgctattgatttgtcagggtgctatactaactgttgataaaagataagtaagtaaggatatcatgcaagagagtcaaaacggtttgaagctatggttatcaatgacggcagtcggcttgttcacatttatgagcaccttggacgcgtcaattgttaatattgcattgcctgttatgtcaaaagagatgaatatcccaatgaatcaagcaacgtggacagtctcaatttatttgattgttatttctggcttgttggctttgtttggtaacttgggtgatcaactcggtaagattaagatttttaggattggaaccattgtattcacactcggttctgtactggcgggaattgatttaggtttgccatttttgttgtttgcccgttttgtacaagccgttggtgcctcaatgacgatgagtaattcattcggaattacgacgacacttgcaccacaaaacctacgtggtagtgcgatgtcattcattgctgcttgggtatcacttggttcaatccttggaccagcgcttggtggtttgttgctacaacacttgtcatggtcatacattttctggattaacgtgccaatcggtatcattgctatcgtggcaggtgcgttcttgctaccaaagtcatcaaagaagggtgtaacgcctcaaatcgattggtttggtgccgtgtcattgttcttgtttgttgctgttttgttccttggactaaacgtggcgcaagtgcaaggattcttggcagcttggccattggctttgattgtcatcgccatcattttgtttgtcttgtttattcgtcacgaattgcatgccgaaaagccattgcttgatttgacgattttctcatcaaagctattcacaatcagtttgattacggcgttcctagtgttcgtcacaaacttctttattaatgttttgatgccattctaccttgagaatttgcgtggcttgagcactggtacatcaggaatgtacatgttgctatggccagttgccatgttggtcttctcagctttgtcaggtacgttggctgacaagatggatcgtgaatatgtgaccttgtttgggttgacggtattggcgattgtcatgttcacgtggttcttcgttgatggtgagtcaccaatgttgctaattggtttgttgttggccggttctggatttggaatggccttcttccaatcaccaaataatgcgttgattatgtcaaacgcacctcaagataagctgggtgtggcgggatcattgaacgctttgtctcgtaacttgggtatgattactggtacgacattggttacgtcagttttgtacgctgctatgagcgctaagttgggcaaggcaattacgacctacccagcacacaaccctgaagtctttgtcttcggaatgcacgttgcctttgcagttgccggcgttttgctggttattgcattcatcattacgttctatcgtgtcttgatgcgtcgtgcgacgaagtaattttaaaaaaattcacgagatgttcgaaattcgaatatctcgttttttgttgagagtggccggttcctatggtatgctagttaggtataaaaccccagggctggggtaattcgtttaaacgaaaatgaagaggagggtgcccacatgtacaacgtattgttgacagcgatgattgtcgttggtgtgttgattattttggcagtgttgatgcaaccatcgaagcaacaagatgctttgtcagccttgtcaggtggtggcggagatttgttcgcaacgcaaaaggcacgtgggttcgaggcagtgatgcaacgaatcacggctattcttggagctatctggtttattttgggattggcactagtttacctttcttcacactaaacactaacagctctatgacctctcgtgacttgttacgaggggtctttgattatttaagaagagtgagatttaaatggacgcacaaaatttgcaggaccaattatttgggttcttgaaggcaaatccaacgcaagcctatccagcacaaacgctggctgatggtttgcgcttggatgatgccaacgcctttacgaaggtcgttcaagcactggctgctttggaacgcggtggtaaggtaaaggttaatgaggaaggcgcattccaatatgacgccgaaaaggaagggattattggtgtcttcaagtctaatgacaagggcttcggctttgttcactatgacgataaggaagaagacgtctttatcaatcctgataacacgatgtttgccgttcaaggtgacgaagttcgtgtaaagttgttgacgaagggtgacgcaaacactggtcgtgggcctgaaggtaaggttgctgaaatcattacccacgctcgtgagcacgtggttggtgaattcacgcttggttcagaatacaagggttacgttggaagcattcgtttgacggataagaagtttgcgtcatttgaattcttggttaaggaaggtggcgtttcagctactgacggtgaagtggtggtggcctcaattgaccaatacccttcatccgttgcaccaaagcgtttcactggtgcgattacggagaaggtcggatacaaggatgatcctggtgtcgacattctacaaatcgtgtacaaccacgatgtgccacacgtcttcccagaagctgtgttggaacaagcaaacaagattcctgatgacgtgcaagacttcgagcgtgagggtcgtgaagatatcacagatcaaccgcttgtaacgattgacgccattgaatctaaggacttggacgacgctgttgttgtctggaagttgccaaacgggaacttccacttgggtgttcacattgccgacgtttcacactacgttgttgaaggcacaccattggatgaggaagcttacaaccgtggtacgtcagtttacttgacggaccgcgtcattccaatgttgccacgtaacatctctaacggaattgcgtcattgaaccctggtgttgaccgtttggccatgtcagccgaaatggaattcaccccagatggtgatttggtaaaccaccgtttgcacacttcagttatgcgttcacacgctcgtatgacgtacaaggcagttaatgctatcttggctggtgacgaagagacacgttcagagtacagcgaccttgtgccaatgttcgaagaaatggaacaattgcacaacgccttggctgctaagcgtacggaacgtggtgctatcgaatttgatgcgcctgaggcaaagattatcgttgatgaaacgggtaagccaacggacattgaattgcgtgaacgtggtttgtcagaacgtatgattgagtcattcatgttggctgccaacgaaacggttgccatgcactttgaccaagcaaacgtaccattcttgtaccgtattcacgagtcaccagatgctgatcgtgttcaaaactttgtggactttgtgaaggcgcttggtgcaccggttaagattgacccagaaaacatcaagtcaacggacttgcaagccatccacaacttcttcttggatcgtccggaagaacaaatggtttcaacaatgatgttgcgtacgatgaagcaagctaagtactcagaccaaccattgggacactttggtattggtgctgaatactacacacacttcacgtcaccaattcgtcgttaccctgatttgacggttcaccgtttgattaagtggtacgagaagaatggtttgggtgaagaggcgcaagctaagtaccgtgacaagttggctcaaattggtgaggatacgtcagttcgtgagcgtcgtgccgttgatactgaacgtgatacggatgccatgaagaaggctgagttcatggaggacaaggttggcgacgaattcgaggcagtagtaaacggtgtcttgaagttcggtatgttcgtttcattggagaacacagttgaaggtttgattcacacgtcaaactttacggatgaccaatacgtctacgatgaagcacacatggctttgatcggccgtcgcttccaccacatctaccaaatcggacaaccggttaaggtacgtttgattcgtgtggataaggaacaatcagctttggacttcgttttggttgatccagatgctgctccaatcactgacatcaaggtgccagaggaccgtcgtggtgcctttggtggtcgcaaccgtggtgagcgtcgtagcaacgacaagaataaccgctcaagcaagggtggtaagacacacaacggtggaaagccattcggtgcaaagtcagaccgcaagcctgaatcaaagcaccagaacaccaaccgtaagggacgtcactaaacaagagcatagagcaacagaaagctttaggaggtcgttaaagatggccaagaaaaagtcaaatgctgatggtgcattggcaacaaacaataaagcaaagtacaactactttatcggtgaaacgtatgaagcgggtatcgaactgacgggaactgaaatcaagtcagtgcgtgctagcaagattacgattgcggatgggtttattcaaattcgtgatgggcaagcttggctggataatgttcacattagtccattcgagcaagggaaccgtttcaatcacgaacccttgcgtagtcgtcgattgttgttgcacaaaaaagaaatcaaggcgctaggtgaggctacggcacaacaaggtaaaacaattgtgccattgcgcgtttacttgaagcatggtttcgccaaggtgttaattggcgttgcgattggtaagcacaactacgataagcgtgaaacaattaaaaagcgtgatcaagaccgcgatttgcgtcgcagtttaaaagtccgctaagcaaaaggagcgaattccaccagaattcgctcctttttgtgtacaatcatccggtatgtcagaaaaactgacatcgtacaacattaaaaaatcggtttggtgtagcataagaggaaatgggaatacaaaattatgactagaggaggattgtgtaatgcgtaaatggctcgttggcctcatggtgcttgcggcatcaatagtggggatggtagcaggggtaccaaacgcacatgctgcatcatcacactacacaattacgaccgatacgacgttcccaccatttgagttccaaactcaaggtggtgactaccgtggtatcgatatggatatgctgaaggaaattgcgaagcgcgaggactttacttacacgttgaagccaatgagtttcaatgctggtgtgcaggcggtgcaagctggtcaagtcgatggtatcttggccggtatgtcaattacagatgaacgtaagcaaacgtttgatttcggaacaccatactacaagagtggtatcgttatggcggttgccaacaagtctaaggtggattcattggatgacttgaagggcaagactgtggcagctaagactggtagttcaggtgcgatgtatgcacaacgcatggctaagaagtacgactttaagattacgtacttcaatgactcaaacacgatgtacaatgacgttatcattggtaacacagtggccgcgtttgaagatcaacccgttatggcctatgccattcaacaaggtacaaagatgaaaatcgtgacggatccagctgatggaaactggtacggttttggtgttaagaagggtgataacgctgagttgttgaagaagttcaacgaaggttatgccaagattgttaaggacggaacctacgataagattgttaaccgttaccttggtgaaggtggatacaactacaaggaaaacgcggctgctaagtcagctgccgaccaatcaatttggtcattgattcaagaaaacaaggccgccttgttggatggtttgattaagacgttgcaactaacagttgttggtatcgttttggctgccatctggggtgtcttgttgggggtgatgggtgttgcgccaagtaagttggttcgtggtatctcatcaacgattatttacatcttccgtggcctaccaatgctagttttggcattctttatttacatcggaattcctaacttgacgggtcaaaagattccagcgtttacggctggtgtgattacgttgattttgaatgaagggtcctacattggtgcgtttgtgcgtggtggctttaagtcagttgaccctggtcaattggaagctgcccgttcattgggaatgccatatggtaaggcaatgcgtaaggttgtgatgccacaaggaattcgtttgacgattccaagtttcattaaccaattcatcattacgttgaaggatacatcaatcttgtcagcaatcggtattatcgaattgacacaaactggaacgttgatcattgcgcgtgatttgcaaggattcaaggtttggttgatgattgccgttttgtacttgattgtcatcacgttgttgacgtggttatctaactgggtagaaaagaggattaactaatggcagcgattgttgaagttaaagatgtccacaagagttatggtaaaaacgaagtcctaaagggcattagtttggacgttgaagaaggcgaagttgtggttatgattgggccttctggttcaggtaagtcaactttcttgcgttcactaaacaagctagaagaaattaattctggtcaaatcaagattaatggttgggacttggttgatccaaagaacaacattgataagacccgcgaaacgattgggatggttttccaacactttaacctattcccacacttgacggttttgcaaaacatgatgttggcaccggtcgaagtggctggtcaaacgaaggctgaagcagaagaaacagcccgtgcgttgttggcccgcgttggcttggcagacaaggcagatgttaagccaaacactttgtcaggtggacaaaagcaacgtgttgcgattgcccgtgcgttggccatgaatcctaagattatgttgtttgacgaaccaacgtcagcccttgacccagaaatggttggggatgtcttgggtgttatgaaggaacttgctgaagaggggatgacgatgatagtcgtaacccacgaaatgggctttgccaagcaagttgcggatcgtgttgtattctttgcggatggttacattcgcgaagaaggcacaccagaagaagtattcaacaacccacaagatgaccgtaccaaggaattcttggacaaggtcttgaatgtttaagcgtaaataaaaaccgcgtatccactgaatttggtgggtacgcggtttttagttttgaaaaggttactcagtcaacttcaacccaactgcagctgcaagaatcaaagcaatgaataagatacgcttccagtcacgggactcgccgtagaagagcatgccgactagggtaccaccaacggttccaatacctgtccaaacagcgtaggcagttcctagtgggatatcacgaatgccgagtgataggaatgacaaactaaaaccgaagctgagtagtaatccgacaatagccccccagtgacgacgacggtgccattcgttcatcatgacaacaccgcttgtttcaccaagaccggcgataataataaataaccaatacatattaggcatcctccataagcttcaatccaatgacaccgaataacaaaacggcaatcagtgatagttggatggcgttcatagcttcgccatagaacatccagttcgcaacaatcgtggcggccgtgccaaggccaacaaagatggcgtaaacagtgccgacgggtaactcatcactggccttcaaaatcatgaagaatgacagaataagtgaggcggctgtcagtaggtacattggccaactgtcagaatgcttcataccaagtacccacatcggttctaagacaaccgctgcggcaacttttagccaggggtttgataatttcatataaatctccttgacgcattaaaataagaaaagcctgggagttagcggcacatttgtcgttaactcccaggcttttatccttccgtgtacgtgcgaggcacgcgtttgctcttggaccagaccactgcgtgcggaaccctagcaaactttttaatgcgatttaattgatgattccagtctatcagactgtgattgacctggcaactcgggatgtaattcgtaagaagacccgagtaggcgttgcggtgttgcgaagaacgagagccaaggagccgtccgaccgctggcaatgaattgccaacgatccaagaaggcggcaatcaaaaccaattgcgcttcatttggttcatcatagatggtaatagctaagcgaccatcgttgtttggttgggtgagggctaattgatgatgcaggtgcgtgatttgaaatttttgtttatccagattacctagaatgagccaatttaaaccgctcacgaatgatatttcgtgtaactgcaacgataaaccaattgaaccaactggctggccgtttactgtcattgtaaagcggggtaggaaacccagcgatgcttgttcaagctcagctaagaccgttgcgctttgattaagtattcgaagtgtatttcctttttgacccatttctccggtaatataataagcgatggctccggtagcgtctgttacaagactcatgccggttgccgagtgggtaacttgtgttaatcgtaattgacgcatcccaaagtcctccttatgactattatatagaattcgcaaaagaaaagcggtgattaacatggagaaattatcaaaaacagattggtgggcgccgttgcaaactgctatggggcctgaatattgggaacgagtggcaatttttttgaaggatgtttatgggcacggtgaagtgtatccagctttgccaaatgtctttgcagcacttgttgcaacgtctttggctgatgtaaaagtggtgattcttggccaagatccctatccgaatccaggtcaagcgcaggggctgagtttttcagtaccggcggacatgggcttgccaaagtcgttggtaaacatttatcgagaactagctgatgatttgcaagcgggcacgccgatggatggtgatttgcatcgttgggcagaccagggtgtgttgctgttaaacacggtgctcactgtgccagctcaccaagctggtgggcacgcaggtcaaatctgggaaccgttgaccgatgcgattatttcattagttgctaaacaagcgcaaccaacagtctttattctgtgggggaagcaggcccaggcaaagcgcaaactgattgttggtgaacacaacttgattttgcaggcaccgcacccaagtcccttgtcagcttatcgtggttttttcgggtcaaaaccatttagtcaaacaaatacttttctgcgtgataacggcgtaaaaccaattaattgggtgtgatgtgaaagaaatcacaatattttctccttttcactagtaaataggctgattatttgtaataatagattttgtaagataaataacgattttaaaagtggaggttttccatcatggaactctttgaacaattgtcatcacaaattaagggtcaaggtaagacgttggtattccctgaaggggaagacgtacgtatccaaggcgcagcgattcgtttggctgccgaagaattggtaaagccaattttgttgggtaacaagtctgaaatcgaagcaactgcagcagcaaacaacttcgacttgtcaggtgttcaaatcgtggacccagctgagtatccagctgacgcccgtgagaagatggttgatgcattggttgagcgtcgtaacggtaagacggacgcagcgactgcttcaaagtggttggaagacgtaaactacttcggaacaatgttggtataccttggggttgctgacggtatggtttcaggtgcaactcacccaactggtgacactgtgcgtcctgctttgcaaatcatcaagactgcaccaggctcatcacgtatctcaggtgcgttcgttatgcaacgcgatgacgagcgttacatctttgccgatgctgctatcaacatcgacatcgacgcacaaacgatggctgaaattgctatccaatcagctagcacggctaaggtcttcggcatcgaccctaaggttgctatgttgagcttctcaacgaagggttcagctaaggcgccacaagttgataaggttgccgaagcaacgttgttggctaagacggctgcccctgagttggctattgacggtgaattgcaatttgacgctgcctttgttgagtcagttgctgctgctaaggccccagaatcagaagttgctggtcacgctaatgtcttcgtattcccagacttgcaatcaggtaacattggttacaagattgcacaacgtttgggtggtttcgaagctatcggacctgttttgcaaggtttggcaaagccaatctcagacttgtcacgtggtgctaacgaagaagatgtctacaaggtagccatcatcacagcagcccaagcaatggcctaattaatgattgaaaatgaactcatggatcgattggtccgtgagtttttttatttccaaattggcgagagaaacgcctgaaaatgcagtcccgctaatgggaaacggcttcctttttcgcctgtaatctgtctgtcaaaaatggtatacttatagctatgagattagcagtgaatacagtagaagaaacacaagcattggctgctaaactagcggccaatgtccaaccaggggacacaatcttattaaatggtgaccttggtgctggaaaaacaacatttacccaaggatttgctagagcgcttggtattaagcgccctttgaagagtccgacgtttacattggtacgtgaatatcaaacagaaaatttcccactgtaccacttagatgtttatcgtctaggcgaagaaggtggagctgaagaattaggcttagatgaatactttggtggtgagggtgtcgcactgattgaatggtcagagtttatccaatctgagctaccaactgacgtgctaacaattgatttggatcgggttgcatcagatacaacgggcaaccaaagaacaattacggttagtgcaaacggacctcgtagccaggagcttttagcagctatcgaaggagaagtgtaatggatgtcatgattagaccggctgaaggccaagatgccaagccaatgttggcgttgttgcatcaattacaatctgaatcaacaacctttatggtagcccaagacttgggcaaggttgatgatgtgaccgaggcggataacattagttacttgcaatcaacaaccaacaatattattttgttggcggcgagtgatgaaggtgacctatttggtatcatttcggctgctgcgctaccaaatcacccacgtgaagtggaagttggtgtcgcggtgcttgaagcttatcaaggctttggtttagcgcaagcactgattgccgagatgctagattgggcaactgagtatagctcagtcgacattattcgtttgaccgttcaagcgcataacgcaccagccattcacatttatgaaaagtttggctttgagcgagtggctggttctgacgcgattgttcttgatggcgcaggtaaaccagttgcagcctttgatatgatgcttgatattacaaactaacaattgaggaatagataacatgaattttgtcgcaatggactttgaaacagcgagtgcacagcgtcatagtgccgtttcaatggcacttgtggtggtgcgcgacaatgtactcgttgatgaattttatacgttaattaagccagaatcgtatttcgatgcgcgtaataccaagattcacgggattactgaggcggatgttgcggatgcacctaagtttccagcggtctgggatcacatcaagcaattttatacgcctaatcaattggtgattgcacacaatgcgccatttgataacggtgttttgcgtgagacgttaggacactacggtatttcagcaccgcattatttgtcactcgacacggtgcgtacttcccgcaagttgtatccacagctatcaaatcataagctgaatacagttgcagcagccctgaatattgatttggaacaccaccacaacgctttggatgatacggttgcagcggcacgcatcttagtgacgcaagctgagcagttcggtgttgatccattgaaacaattagtaaaagttatttagcggagaaagagtaatgacaacacaactaaagacggcctttccggggctagaaattcaacaaaacgttgatttgtcagcttacacgaacacgcgtgttggtggaaatgccgaatgggctttctggccacatgatgatgaagaattacgtgatgtcttgttgtatgccaatgataatgaaatgccagtaacggtgcttggaaatgcgtctaacttgattattacggatgccggcttagtaggcttggttattttcttaactaagataaccgacatcgccgtatctggtacacgcattaaggcgcatgccggcgctgccatcatcgatgtgacgcaagttgcgcgcgagcacgatttgtcaggtatcgagtgggccgcaggtattcctggttctgtcgggggtgccgtctacatgaacgctggtgcttatggtggtcaagttgatgaatggcttgaatcagctgatgtgatgacgccaactggcgaaattaagacgtacacaaacgaagaattgtcttttgcataccgacacagtttagtgcaagaaacgggcgatgttattttggctgcgacgttcaagttggagccaggcgatggggctgaaattgaagccaagatggaagacttcaaccaaaagcgagcaagtaagcaacctttggagttcccatcttgcggatctgttttcaagcgtccagaaggttactttgctggaaagctgattatggatgctggcttgcaaggcttccaaatcggaggtgcacaagtgtcaacaaagcacgcaggtttcattgttaatcgtggggatgcaaccggctcagattacatcaatgtgattaagcacgtgcaatcagtcgtcaaggaaaagtttggcgttgatttggaaactgaagtgcgtattttgggattgtaatttgtaattgaattaggggaggatttatggagctattacaaaccatagtggcattaacgtcattggtggtcattagtaatattttgtctcacttcctcaaacgtgtgccggtcagcttgatccaaatcgctttgggtctgctggccgctttgtttttaaatctacacgttgagttagagacagaatggttcttgttgctgtttattgcaccacttttgtattccgatgcttggcgctttccaaagaaagaactttgggagcttcgcggagccattttcggaaatgccatcttattagtctttattacaacaattttaggcggatttatcatttatgcgttggtaccggagctgccattgccggttgctttggccatcgccgccatcttatcaccaactgatccggtggctgtggcagcgattgcgaagcaagctaaattgccaccatcaatcatgcacttggttgccggtgaaagtttgattaacgacgccagtggtttggtgggattcaaatttgctgtcgccgctgcgtcagctgggacattctcactatttgccgccacatctaatttcctttacatctcgttgatgggaacggttgttggactggtattgggatttgcattgaatactttgggcgattggttatcagctcatggtaatactgacgttgttttccgtgtggtgcttcaactgttcacgccgttcttagtttatctgttggcggaagagctacacacatccggcgttatcgcggtcgtggtggctgctattgttcagaatttgcatacacaaaatgacgccgattattctggtgagttgcacgtggtggggattaacacctggaacgtgtttggttacctcttgaatggttatattttcgtcattctgggaattgaattgccattggcgacgaacctgggaaattcagtgtcattaccaatggcgttgctatacgctgtcattacttggttagtcatcttcggtatgcgtgtgatttggacgtacattaaccaatgggttcgcttgaagaaccacaaaaatgaaaccgcttcttggcgtgtggcattgttgtcaggtttgtcaggtgtccgtggtgccgtaacgatggccggtgtgttgtctgtacctctgatgacggactcaggcttgccgttcccgcaacgttcattgatgctattcatcgctgcaattgcgattatcatttcgctactggcagccgttatcttcttgccgctattggctgaaaagccaaagacccaagtgccacctggtgatacggaagcacatccggttgtagcccagcacatgtctgaagcacgtgcgcgtgtttatgtgttgcaatcagcggttcgtgaaattgaaacgcgtcgtcgcgagtcaaatcaagcgattgcttacgaaattattttgcgttaccaaatgcaaattcgtcagttgcagatgcgctttatgaaggcggacaagttgagtccaattttgaaggccgaaattaacctacgtgagcttgccttagatgccgagcgcagtgcgctacgtaaattgttagttgaggaacgcattacaccattggtctttgccagtgaaaaccgccgtattgatcgtatggaagccgacttggatgatttggtgacgcacgataagcgtaagcgcacatggcgccaacttaagcgtttcgtggtcatgactcgtcgatcaattcgtgtttggttaagcgacgattcatctgatcgtttgattgcggaatacaaggttgcccgtcacgaagccgccaaggaagctattgcagctatctcggattaccttgagagtgaggcaggtcaagcttctaagacggatcaaacggcagcttataatttgattattacgtaccgttcacgccttgagcatgagaagcatgatcatggtggtccacaacaagaagcgcttgttcgcatggatttggaagtttctgggttgaacgcacagcgtgaagcgacgcaacatttgtacgatgcccactttatctcagcagaaactgggttgaagattcgtcaaatgattaattttgctgaagctggtatgttgactgatgaagaagaataggggacgttatgaacattgattttgagtcactcataaagactattagcgtcgtccggattatcgatattgtcatcgtttggtggctgttgtaccgcttgatgatgttgattcgcggaacgaaagccgtcacgttgctacgtggtgttggtatcgttatcgcggtcaagctaattagttggtacgttggtttgacgaccatttcctggttgactgatcaaatcattaattggggagttattgctttggttgttgtgttccaacctgaaattcgtcgtggtttggaacacttgggacgctcagctttattcaagcaaaagcaggcataccagcaagaaacgcgtttgattaatgagttggatgatgccattcaatacatgtcaaagcgtcatattggtgcgctgatttcaattgaaatggagactgggttggaagaatacattgaaacaggtatcaagattgatgctgaagtttcaagccaattgttgattaacacgtttatcccgaatacaccgttgcacgatggggcggttatcattaaggacgcgcgattggcagcggcggcagcatacttgccgttgtctgataacccaacgattcccaaggaattaggaactcgtcaccgtgcctcagtgggtatttccgaagtgacggatgccctcacgattgttgtgtcggaagaaacaggggatgtgtcaatcacgcgtaatgcggaattgatgcaatcgctgtctcgcgaagattaccgcaagtacttaacgcgtcagttggtaccagctgatggggatgtcaagcagacatggtggtcacgcgtgataccatttggtaagcgaggtgagaagtaacatgaaaaaaggatatgacaaaattgtctatgttgttgcgactttgcttgttgccatcttgatgtcagcttatgccgacggacaatcaaatgggacaacgcgtacgaagactgcgacgagcgagtcgacgacgggtctccttaagggcatggtatcctctaaaacggagactgtagcagtgccagtgcaattgacgggcattgatactgatgattattatattaatggggtgccggatacggttgatgtcacgttaaccggttcatcggctctcgtgacggctgctaagaataccaagaactttcaagtttatgcggatttgaagaagttgaccgatggtgagcacacggttgctttgaaggtatcgggattgaatcgcgatttgacttataagctagccaagcaaaaattgacgattaccatctacaagcgtacgtcagcttattacaccgttcacacggactataataaggacgccatcgctgatggttacacagttggtacggtgacatcttcagtcaacaacgtccaattgatgggtcgtcaaagtgcgattgattcagtttcaagtgttgtcgctgcagttaatttgcaacgcgatacaaagaaatctgtctcacaggaagttaacctacaagcgcttgatgcgaatggacacgtggtagatgttgcgatttcaccacaagtgacaacggttaagattccggtttctgctggtacgggaacgaagcaagtgccggtagccattaaaacaaagaacggcaatgccgataacttcgatcttacaggctcggtgaacgaaatcacggttcgtggtaagattgatgtattgaacaaaataaaggaaattccagttactgttgatttgtctggcgtaacaagtgcgtcatcacagacgattactgttaacacgccagaaggtacagacagcgttgacccaacgacagtaacgattacaattacgccgaaggagcagaattaagacatggttgaattacattactttggaacggatggggttcgtggaattgcgaacaaggagctaacgcctgagttggcttttcgactaggacgaatgggtggtgcggtattgacgcgtcacgctgaaggacgtcgcccacgtgtgttagtaggacgtgatacacgtatgtctggtcaaatgcttgagcatgcattgattgctggtttgctttctgtcggtatcgaaattttgcgtttgaacgttatttcaacgccaggtgttgcttacttggttcgtgcacaacaggctgatgctggtgcacaaatcacggcatcgcacaatcctgctgaagacaacggtatcaagttctttggtgctgatggtttcaagttgtcagacgaattggaagctgaaattgaagcgttgttggatgcgccagaagatacgttgcctcgtccagctgctgaaggtctgggaactgtctctgacttcccagaaggggctgctaagtaccttgagtacttgcaaacgacgattcctgatagtttggatggcatgaacattgctatcgatgctgctaacggtgcaacgtcaggccttgtcgcaaacttgtttgccgatatgggggctgattttgtaacgatggcaacatcaccagacgggttgaacatcaacaagggtgttggttcaacgcatcctgaagcaattgctaagttcacggttgaaaacggtgcccaagttgggttggcttttgacggtgacggtgaccgcttgattgccgttgatgagaacggtgacattgttgatggtgacaaggtcatgttcatcacgggtaagtacttgtcagaacatggtcgcttgaagcaagacaccattgtgacgacggttatgtcaaacatcggtatgtacaaggcaatggctgagcacaacatttcatctgttaagacggccgttggtgatcgctacgttgttgaagagatgttgaagtcaggttacaacctaggtggtgagcaatcaggtcacgtggtcttcttggactggtcaacgactggtgacggtatgttgacggctttgcaattgttgcacgtgatgaagtcaacgggtaagaagttgtcagagcttgcagctgagatgacggtttacccacaaaagttggttaacgtgaaggtgcaagacaagaaagctgccttggaaaacgaagcaatcaagcaagtgattgctgaggtcgaagccgagatgggtgacaatggtcgagtccttgtgcgcccttcaggtacgcaagatttgttgcgtgttatggctgaagcccaaacgaaagaacttgttggtgagtacgttgaccgtattgtagcggttgttcgtaaagaagttggggtagactaataatggctgcagagtatcaaacgcttgatatcattgaagaaattacgcgtaatgatggctcgacctacaaagaaattggaaatctattgcataatggtcaagctgagtacgcggctgagcaggggatgattaagagtgtccgcattcttaagattaatatcccgcactcaggtaacgttgaaaagtatgaaaagtatgtaaatgagaattttgaaattccagagatggtagccatcaaggaatacactgaatggacgaagacaccagagatggatgaaatcattcagaaaatcctcactgaaaatcaggttagttaataaaccaattaagcaacaatccagtgcgattgttgctttttttgtgcagttacaatatccttaaagaacttaaaccttgggggaggtgtgcatcttggcaacaattgttgaaaaactaaatacggttcgaaatgccaagcatgtttcacttgaaacgattgcgctaaacggtatttcggctgatcgctatcgccagttcgtacacagcaatgacaacattatgcttggggaaatcacgaccatgcttgatttgttaacgatgtcatttgcagaactctggatggatactgatgaatgggatgacacccatggggtgcaactagacggggcccaaacgatgtcggctgaggagctggcgcagaaacgtgataagacggaacaagagtatcgaaatactggttacaagggattccatctaatcgccttgacgttcgatgttttgtataagcgacgtgtgcaagtgtcgtatcgcgagccactagacgcgttgttgggtgaattgtctcgttatcagatgttcacccattttgaaatgcaggtgttctcgcaacttgcaccggtattacgggcgtcggaattctacccattatatgaaatctttattcgtagtgtcccagagttcacaagttatattccgcaacgggttggtgaactagttttgcgcgttcattatcgcgcgttggtgttgttgattcatgattcagtgaattcagttgagacgatgcgtttcgttttgcatgcgatttcaaagcaacccaataatgctggtaacttagaattgcgtatgctggctcattatgcagaactgctggaagaatatttctttggtaatccagttcatgcagctaatgaatttagaatcttcattgaggccgcacagcgacgacaggttgcgttgatgtcgtttggtgaaatgacgttcgacttagcaggtatttggcaagtggtcacgtcaaagcgccaccacttgaagaatgacggtaagagcttatttaccaagtcgtatgaagagcaaacgtttgtgtcgttgaatgaaaatattcgtgatagcgtggcagacatctgcatggtgaagggaatttcaaaagatgaattgctgagtttcggcatttcaaagcaacgattagacgtgattgttgaccagccagaattaatgacgctcacggaaatgcttaagatgatgcatattctacgtgttgagccgacagatatcacagtatatgcgaagttgacggtacgaacgccaggcgtagactggaacgattcatttgcggcttgcacggccgaagactttaaaacgatgattcaaacggaagaagatgcgtatgagcgcactgaaaacccgcgtcacttgttaaatagttttacgtatcgtggtttagcgggtcaacatctgattgataaatggttgttatcagatgatgccgcccagttagcgcgcgatgtgcaggggtatcttgatagcttgcaggtttggcaggaagcggaccatcgtgtcgcacgttgggcgatgcttgattgcgaagatatcgaggacgtcatctatcgcgcattgtttttgagtcgtcacgtggaaaatcgagatatcttccggacgccacttaatgtggtgttgcatgacttggagccggttttgattcaggcgttgcttaagcgagatcaagcccgctttgacaaaattttgacggttatgaaccgcgctgcagctggtgacagcaaaattatgcagtgggcaaattggcgcacacgcatggcaattaataatttatatgcgacatttttcgatgatccagttgaagcgatgcgccagttagagcgcttctttacggattatcacatgctgacggggaagccgtttatcacgtcacgctatcaagtgttgcttaacgacattagtgatagttacggcttagcctaaaaaacgacccacacaaatctgtgtgggtcgtttttgctacttcttcaaggctttcttagtcgtctcaacgtgtgcttcgtaggctgcactcgtagtggcaggcatttgtgtcaacatccagtttggcatcaaattcttcatgaaaatcctcatctcttttctcttgatgttattagtatagttggacgacagtcctatttaacggaaagtgtcaaaaatgagacaaaatcgcccgcttttttcatagtttatgggtatcatgaaggaaatgatgaaaggagcagccaccatgacgcagatgattgctgaacgaattaatgaaattcgtaaaaacaagaacgtttctgtccaaacaattgtggataacgggatttcgaaaagtaaatattttgcctttattcgcggcgaacgtgatttggcaatcagtgatctgcagattttgatggatgtgctgatgatttcatttgccgaattagttgtggatactgatgtggtccaagcgccgttcacgttgaatttactgcgtgctcgcgatttgacgttaaccgaactagaggtttaccaaaaagccttgtgggaaaaatatcaacgaacccagttggtggcgtatttccaatacaatttggcgtttcagtatctgattgcgcataagcaggaagtggactgtaagccattcgtgacggcgatatatgaagaactgaaggattaccagttgttcacgttctttgaaattcaactcttttcgattatcgctgataagctgaccccgaaaagattctatcgaatgtacgagattttcactaagagtattgggatattcgccggctacatgccgatgccaatctacctaacgattttgcgtattcattattacgcgctcgtacacttgatgcgtccaaccctaaagtcactgccgacgatgttatttgtgttggatgccattatcaatcaacctgcgcgaccatccaatgttgaattgtttatgctacgccaattcgcgaagatgctgaagtcgtattacattgaaaacagtccagcggctgaacgtcaatttgcagagtggattgcagtggctgttaagcgaggaagtcaggaagtccgaatgacatatgacaccatgtcattccctggactctggcaagcacttacaatgaagcgacaccacatgaagcacgatgccccaagcatgttttcaacaacgtacaatgacttacctaaggcggaaatgccagatagttttggagttgccttgcgttatttgattaagggaaaacatatcaatagtagtgaattaacgcagtacggggttacgcggtctaagttgtaccgaattattcaccaggaagtagcgattcgtttggaagacttgtttgatatgatgaggtacctgcgattgctgccagcggatttaactgtgtttttccaggtgaatccgaattcaaaggctaagaatcgttttgcggccttcgatgttaatccatatgactatcaaactgtggctgaacaagcgctagcagagtacggtaggactggtaatcacgctgattatgaaacggcgttagagtttcaagtctatgtgaatcaacaattgtctgattttgatccgacgagtattatccaaatcgacttggcgaaaacgattacggaatacttgctacatttggatgaatggcacgaagcggaacaccgcctggttacctattcgtttgttgatttagataatgtcgacctcatcattaagcgactcggaattgcggatgagtatatgcataatcgccaggttttccgcgcgccgattagctcagttctaaataatgctgagtttgtgttgctgaagtacttacttgaagacaatcgtgaagcctttgatcgcatcctaaagattgcagaaggtgaggttcagcgtgatccacgtatcttcacgtttgcaacgtggcgctggcgcctagatgtttaccgggtttatcaaatgttcttcgattatcctgaagtcggtttagccgcgttcgaggactttgtctgcgactatcagcgcctaacggggaatcaactatttaaaaacgaacggaatttcatcgccgatacgcttcgtcatcactttaatttgattaacggaattgcgcaaatgcaaaacgattcgcttgacgaataaaaaaagttgcgatatttgtgtcaattctggcacttttgggttgatacccgcacttatgtcttaatcttagttcatagccaaggggcaaacggaaaaagaagagatagaaagtgagaggtggagacatgaattggattcctgagatgatgaagcgcgcggccaagtatggtggtgatttggatcaccctgaagtcgtggcatgggcacatgaacaatggcaaaaagcagccaacgagtggcgttatgaagtcgacggtgaacaccgtttccgcacgcaagctgaactagctgcgtacctccacgttggtaagatgcaattgaccaagtttatctcaaagggtgttgaagagttccaattgcgtggatacatgatccgcgtcaacgacgacgtctttatggcccgtgaacaagaagcacaaattagctaatcacaaacactgcaatcttcgggggttgtggtgttttttgtttagttggtggtttgtgtcgacgcgttgcgtcgaggtatgggggcgcgggactatctccggcaaagttcaaatcagagcaaccgaatggcgcggacgccattcagcggggaaataattccccctaatccttctagtcctgaatgggcttacctgaatagcgccggccatgcggcatgttgccctgatttgaacgctccgatagtcccgcgcccccataccagcaagcaagatgttctattctgtttgagatgaacatctaccggaaaacaaacggttaaaaagttcaacttattatcttgtggtagatgaaaatcaaacaatcagagtagtactcggctgctgtgcttggccccgccacgcgtatagacacgtactgcccttgacccgcaggtgtgggttcttagcggttttactgcttagagccacgggaggtaaaggagcacacgccaacggcgtggactccgctccctgtaggtcatggtcggtacgtgttagcgtgcctcagaaggggccaagcactccggccgataggacggacacacaccactacctccatttaactaaacaaaaagaagtatttaacccaattagtaaaatgtaattaaactgtaataaaaacaagaaccctatcatagcagcacgttaaacgttttatgaaattttgattggtaaaaagtcatatttacgtcatgaaatgcccgtgctatagtattttcaacaacaaataaccttttaaatttttagtcccgtgaggctacaaagggttgcgttgattaggggtacaggggaaattcaacactcgcatggggaaggactaccaccagactaatcagaagcacagcctcgtgaatcactggattcacgaggcttttttattgcagaaaaggagtggcacatgcggcattttgttaacttgaacgatttaccaaccgagacgattatgactttgattgaggatgcgttggcttataagaacggatcaaaagatgtcaaacagtcaaatcgattggtcgccaatctattttttgagaattcaactcgtacacattcgagtttccaggttgccgaaacgaacctgggttggcaccaagtcatgattgacccacaaaccagctcgacccaaaaaggtgagagcttgagcgacacacttaagacgctcggggcaatcggggtaagcgttgtggtactgcgccacaagattaatgactggtatgcgccattgattaaggaagcaacaccttacatgccacaacttgttaacggtggtgacggtaatggccaacacccatcacaaagcttgttggatttggtcactatctatgaagagtttggtaagttcgaaggattgaaggttcgcattgttggggacttatcacactcacgcgtggcacgttcaaatgctgaaattttgcaacgacttggtgcaacggtttcatttgctggtccagaagactggtacccggctgatttcgaccaattcggtacgtatacgacgtttgatgctgatttagccgacttggacgtggtgatgttgctacgtgtgcaacatgaacgcatcgcgaccgttgaaaatgctgacttttcaccgattacgtaccactttgaatacggtctaactgaggaacgctataacactttgaaagattcagcaatcgtgatgcacccagcgccagttaatcgcggggtcgaaattgcggatcaattggttgaggcaagcaagtcacgcatcttccaacaaatgacaaacggggtttacgcccgcatggcgattttgaacgctttaactgaggagaattaacatggcaagtttgctaattaagaacgcacaagttgtgtcacatgatgatgaattgattaaccaagacgtcttggttgaagatggcaaaattgcagcgattgatgtggttttggatgcacaagctgaccgcgtgattgacgcaaagggagcgttgctaacgccaggcttggttgatattcacgtccacttccgtgagccgggttttgaatataaggaaacaattgcaaccggctcaaaggcttcagcacgtggcggatttacgacggtcgcagcaatgcccaacttgaatccagtaccagcaacggttgcagcattccaacaagttcaagctaagaattcgactgatggggtggtgcatatcgaacaatatgccgcaatttcagaaggtttgacgtcagatgatgtgagcgatatccaagcgttggctgatgccggcgcggttgcctttacgaacgatggtaagggtgttcaaacggcagcaacaatgctaacggcgatgaaggccgccgcagcagttgaccgaccattagtggcgcacttggaagatgagtctttgatgaacggtggggtgatgaacctaggtaagcgctcagaagaacttgggttgccagggattgacccattggctgaatcatcgcaactcgcacgtgacttggtattggccaaggctgcctgtgtacattaccacgtggcacacctgtcaacgaaggaatcagttgccttggtgcgtatgggaaagcaaatgggcgtgaaggtgacagcggaagtttcaccacaccacttgttgttggacgaaaatgacattgacggtgacaacgccttgtttaagatgaacccaccgctacgtgcaccagaagatcgcgctgcggtgattgctggattgctagacggcacgattgatatggttgcgactgaccacgcgccacacagcgtcgaagagaaggaacgttcatttgtcggggccgcctttggcattaccggtatcgaaacaagtttccaattgctatacacgcatttggttaagccaggcattgctagtttggagcagttgctaaactggatgattacacaaccggctaaggcctttaatttggcagcgccaacgacgctagctgtcggcgaaatcgctgatttggccttgttcgatttggaaacggcacacacgattacagcagatgaatttgtatcaaagggtgtgaatacaccatttatcggggaaacaatttacggacaaacagtgttgacggtcgttgccggtaacgttgtttatgaagcataaggggaagaacatgaagcgctatctggttttggaaaatggttcagtgtatgccggcgaggggttcggatcattgaagccggtcgttggagaattggtttttaacacaggcatgtcaggctaccaggaatcaattactgacttgtcttatcacggtcaaattttgacgtttacgtacccattgattggtaactacgggattaaccgcgatgatttcgaatcattgaagcctgccgcatcggcgattgtcacgcacgaaattgcccgtcgtccatcgaactggcgttcacaaatgtcaattgcggaatgggccgaagcaatggatttgccaggtttgacgggcattgatacacgtgctttgacgaaggaacttcgtgattatggtgttatgaaggcaacgattgtggacgaagtaacggagacaacggttactgacttgcaagcaacacaattgtcaaaccaacaagttgccgaagcaacgacgaagactacctatgtgaacccaaccgaaggggtttcaattgcgatgattgatttcggcttgaagaactcaattctgcgcgccttgtctaagcgcggggtgaatgtcatggtattcccagtggatgttgatgccaagacaatcttggatatgaatccagatggcgtgttgctttcaaatggacctggtgatcctgaatcagttgaaggtgtcttagatgtcattcgtacgttgcaagaccgcttgccattgatgggaatttgcttgggtcaccaactattctcactcgctaacggggcagaaacgtacaagttgaagtttggtcaccgtggctttaaccacgcggtgcgcaactttacgaatggtcgtgttgacttcacgtcacaaaaccacgggtacgccgtttcagctgaatcaattgttggcacgaaccttgaaatcacacacgaagaaattaacgaccacaccgttgaaggcgttcgtttgaagaaccgcccagcattctcagtgcaattccacccagatgctgcgcctggtccacacgatgccgagtatttgtttgaccaatttttggagatgattgctgaagagaagaagggggcgtcacatgcctaagcgcgaggacattaagaaggttttggttattggttcaggaccaatcgttattggacaagcagctgagtttgattactcaggcacgcaagctgcgatgtcattgaaagaagaaggctatgaagtggttttggttaactcaaacccagccacaatcatgacggacactgagatggcagataaggtctacatcgagccattgtcattggaattcttggaacgcattttgcgcaaggaacgtcctgatgccatcgtaccaacgctgggtggtcaaactggtttgaacatggctaaggatttgtctgaagctggtatcttggccgagttgaacatcgaattgctgggaacgaagctatcagctatccaagaagctgaagatcgcgaagagtttaaggacttgatggatcgtttgaacgaaccggtaccagagtcaacgattgctacgacagttgaagaagcggtggcgtttgccgacgagcacggttacccagtgattgtccgtccggcctacacgctaggtggaactggtggtggtatcgccaacgatcacgcacaattggttgaaatttcagcgaacgggttggaattgtcaccagtaacgcaagtgttgattgaacgttcaatcgccggtttcaaggaaatcgaattcgaagtgatgcgtgatgccgctgacaacgccttgattgtggcttcaatggaaaactttgatccagttgggattcacacgggtgattcaatcgtggtagcgccagtacaaacgttggctgaccgcgagctacaaatgatgcgtgacgcagccttgaagattatccgcgccttgaagattgagggtggggttaacatccaaatggctctggatcctgagtcatttaagtactacattatcgaagttaacccacgtgtatctcgttcatctgctttggcgtcaaaggcaacaggttatccaattgccaagatggcggcgaagattgcggtgggcttgacgttggacgaaatcattaacccagtaacgggtacgacgatggctgagttcgagccagctttggactacgtaatcgttaagattccacgctggccattcgacaagtttgcttcagctgaccgtcgtttgggaacgcaaatgaaggcaactggtgaagtcatggctatcggtcgtaacatcgaggaagccatgaacaaggccgttcgttcacttgaaattggggcgacgggtttgaacgacatcacgtttgataatacgacggacgcagatttgctagatgccttgatgccagcacgtgatgatcgtttgttcatgattgctgacttgttccgtcgtggtgtgtcgattgatgatattcacaaccgcacgaagattgactacttcttccttgataaggtcttgcacttggtcgagctcgaacaagcattgaagcaaaacgttggggatgccgacacacttgaattggcaaagcgtaacggttttgcagataagacaatcgcaggcttctggggtaagacagttgctgaagtgcgtgaaatgcgtcgaacgatgggattgcaaccggtctacaagatggttgatacggtggcggctgagtttgaatcacaaacgccgtactactactcaacatacgaacaacaaaacgaatcagttgtgacggacaaggaaagtgtcctggtgttgggttcaggtccgatccgtatcgggcaaggtgttgagttcgattacgcgaccgtgcatgcggtaaaggcaattcaagcggcgggctacgaagctattatcatgaattcaaatcctgaaacggtatcaacagacttctcagtttcagacaagttgtactttgagccgttgacgttggaagacgtgatgaacgtgattgatttggagcaaccaaagggtgttgtcgtacaattcggtggtcaaacggcgattaacttggccggaccacttgctgagcacggtgtacaaattttggggacgacagttgcggacctagaccgtgccgaagatcgtgaagagtttgatcaagtgattaagcaacttggtttgccacaaccagttggtaagacggcaacgacagtggctggcgcattggctgcagcggatgaagttggttatccagtcctcgtgcgcccatcatacgttttgggcggtcgcgccatggaaattgtgacaaacccagacgaattgacggactacatgggctgtgctgtgcaagtgtcaaatgatcacccggttttgattgactcatacttgatgggttcagaagcggaagttgatgttttgtcagacggagaaacagtcattattcctggtgtcatggaacacatcgaacgtgccggggttcactcaggtgactcaatgtcagtttatccagcccaaacgctttcacaaaaggtgaaggatgaaatggtggcagcgtcaatcgacttggcgaaggcgatgaacacagttggtttgatgaacgtccaattcgttattcatgaagatacggcatacgttatcgaagttaatccacgtgcttcacgtacagtgccgttcatttcaaaggtgacgcacttgaagttggcgcaattagcaacgcgtgtcatgctaggcgagcgattggccgacatgggctttgaaacgggggtcatccctgagcctaagacggttcacgtcaaggccccaatcttctcattcacgaagttgccagatgttgactcattgcttggaccagaaatgaagtcaactggagaagtgatgggatcagattcaacgttcgaaaaggcgttgtacaaggcgttcgtcgcatcgaacgtgaaggtgccaacatttggtaatgtcttattcacggttgctgatgaagacaagggggaagcactagctttggcacgtcgcttcgatgaccttggtttccaactggttgcaacagccggaacgggtgctttcttcgcccaaaacggtttgcgcgtcgatgtgttggataagattagcgaaactgataacaatgctgtgacggcaatgcgtgatggcaagctccaaattgttgtgaataccacgcgtcaagatggaacgacgatgtcagacggtcgtttgattcgtaacgcagccattgaaaatgcggtgccgttgtttacggcattcgatacagtggcagccttgttgagtgttttggaatcacaatcattcgctgttacgccaatggactaacagacataaaatacccggctacggctgggatacatatagaaagagggagaatttatcatgactgaagatcgatttgcagtacaactaccaggtttggatttgaagaacccgttcatgccgtcatcaggttccttttattacgggcttgaccacatgaaggattttgatttgatcaagatgggtgcgttggttttgaagacaacaacggttgatgaacgtcgtggtaacccgcaaccttggattatcaatacacaagccggcatcatgaattcagttggcttggctaatccagggatggataaggtagcaactgaaattctgcccgagttggaaacgcaattgccagatttgccagtgatgatttcaatcgctggcgagtcagtggctgagtatcgtactttggcaaaggtctttgataagttcgattacattaaggcattggagcttaacttgtcatgcccaaacgttgataagggaggcatggaatttggagttgatccagatagcgcagccgaagttgttgcggcggttcgtgaagtaacggataagccgctctatgccaagctatcaccaaacgtaaccgacattaagccgattgctaaagctgttgagaccgctggcgctgatggactggtgttgattaacacggtggtggggatgagcttggatattgcatcacgacaagttcgtctatatcgcggtacaggtggtatttctggggtttcagttcacccaatcgctgtgcgtatggtttgggaagcggcttcagttgttgacattccaatcattggcgttggtggtatccgctcaatggatgatgcgctagagttgatgttagctggcgcatctgccgtgcaaattggggcgatgaatgccgaagacccactctttatcagcaagttagttgatgaactgccagtggccttagacaaatataactttgcgtcagttcgtgagattccgacggcgctacaaaagttcccagcgcctctaacggcatgggaagctaatcacccgggagacaattaaacaatgacaaagccagtatttattgccttggattttccagatgccaaaacgatgtgggggttcttggaccaatttccagcgagcgtccgtccagctgttaaagtagggatggaattgttctaccgtgaaggaccagccttggttaccgcattgaaggaacaaggcttcaccgtctttcttgatttgaaactatacgacattccaaacacagtgcaacaggcgacgaaaaatgttgcgcgactaggtgtggattatttgacggttcatgcagcggggggtgtgcgtatgcttcaagcagctaagaagggtgcacaagaaggggcagacgcagttggcgtaacggcacctaagttgctagctatcacgcaattgacctcattttctgaagaagaaatgcagactacccaacttgtgacggtttcaatgcgcgagtcggttattcacttagcgcaactagctgctcaagccggtgtggcggggaccatttcatctgcattcgaatcagcagacattcacgcgaacacgccagcgggcttcttatcaattacgcctggtattcgattggctggggatgcagttggtgatcaaagccgtgtcgtcacaccagcacgagctgccgaaatgggcgctgatgggattgtggttggccgttcaattacgcaggcaactgatccagttgcagcttaccaacttattgaaacagaatttaacgcttaagacggagaaaaaacttatgacagattacaaagcagcagttgctcaagccttgttggatatcgaggccattaagctacaaccaaatgatccctttacgtgggcatcaggtttgaagagcccaatttatacggataaccgtaagacgattgctttcccgaaggttcgcaagttgattgcgaagggcttggctaatttaattaagcatgagtacccagaagtcgaagttatcggcggcgtagccacagccggcattccacacgcagcttgggttgcagctgaactagaattgccaatgatttatgtccgttcaaagccgaaggatcacggtgctggtaagcaaatcgaaggtgaactaacagttggtcaaaaggttgtgcttatcgatgatttgatttcaacaggtggctcagttttgggcgctgttgaagcaacgcgtcgtgaaggtggcgaagtgctgggcgttgtctcaatcttctcatacgaattaccagcggctgacgaaaacttcgcagctgccaagacgccattcgcatcattgacgacttactcagctttgattgatgcggcgattgcatcaggtcaagtagatgatgctgatttggagaccctacaagcctggcgtcaagacccaaaggcgtggggtgaagcacgcggataacggatagataagcgcttacaaggtgcgttattataaacatgtaccaaaggaagaaaggtagatgataactttggaagaaacaattatttcaaccacagtagtgccatcatctactgcaatccatgcgggcgtgtcacagtaatgacgcaagataacaacacgtatcatttttaagagataaacgcattagtcatgatttgacatctcttgcgatcattagcatcggttacttcgacgacggacgataatccagcgatggatgtaagcttgttcagagattggaggccgctcccgacacggtttgatgaataattcaaatagcttggatgcggtagagatgagactatagatttggttgtgaccatgccttagcgacagacgactaaaactgcagattagttctctaaggtggtccctttacaattgaatacagggtggtggagtagcacttccctagctatgtgtcgcaaatcatagctgaagtgaccgcgggccaacgtgccggcggtttttttgcgcgaaaatttgacaagataaagtagacttgctctttcgcctgattaaggtcagcggggtagaccaacggctactgtgataaaaattcacaaagccatcacgactgcctatcccaaaaccggatgattgttggtagaatgtaagatgagacaaattgtgaaaggtgacaaatcatgaatatcggactattcacggatacctatttcccacaggtttccggggttgcaacatcaattcaaacgttgcaacgtcaactggaagctaacggacataaggtttatatttttacgtctaccgatccgaaggtaaaaaaggggacgcttgaaccgaacatctatcgttttgcaagtttgccattcgttggatttaaggatcgacgcattacatatcgtggtgcgattcaggccgtacaattagctaaaaaactacaacttgatatcgtacacacgcaaactgagttttcgctcggcgtaatgggaaagtttgttgcacgtcaattgaagattccagttgtacatacgttccacacgaattatgaagactacttgcactacattgctaacggtaagattattcgcccaggtagtgtggctgtgattgcccgtaactttatggcaggcatgactggtattatttcgccatcacgtcagacgtacgatacgctgatgaagtataaggtgaaggcaccgattgagattattccaacgggtgttaatgtgcttcactcagcggcagaagatacaagtattgccttgcgtgaaaaattaggtcttaagccagaaacaccagtggtattatcattgggacgcgttgcttttgaaaagaatctcgatgatgcactatcagtattcgctgaggccttggaagaggtgccggatgcgatgttcatcatcgttgggggcggtccggcgatgtcggctttgcaagaacacgtttcagcgttagagattgacgaccatgttatttttactggagaggtcaatcacaatgatgtctatagttattacaagatgggtgatgtctttgtgtcagcatcagtttctgaaacgcaaggactaaccttcattgaagcgatgacggctgatacacccgttgttgccattcacagtccctatcttgataccattgtcactgatgaaaacatcgggacactggttgacgatagttttggactgcttgaaccaatggtcatgtatcttaaggctaagaccacaggtgagacgattggcaatcctgagacacgggcagctgtgttgcatgagattgacgaacgaacatttggtaaacgcgtcattgatttctatgcagaagcattggctgtttaccatgaagaggaggatacggaagctgccgaagcaaacgatgtggagtactcaaaaacattcctgcttcggaatccattccgacgagatgattaatgattagaattacgatgttttcttcagctgaaacggtacctggtcaaggtgttgggtcagcctatcgtgagttgataaatttgttgacggcgcggtttaaagataagtttcaagttcgaatcaatagtttggcaccagctgacattagtcactaccacaccattgatttttggttttatttgaacacgttcttacctggtcgcggtcgtcgtgttggctatgtgcactttttacctgagacattagagggttcgattaatttgcactggccagttaagaatattttttattggtatgtgatggcgttttacaagcgtatggatcacattgttgttgttaacccaacgttcatcgataaactggtggcgctaggggtgaaacgtgagaaagtgacgtacattccaaactttgtcacgaagacgcaattccatccattaccggatgagcaaaaggtggcacttcgtaagcagttcgatattgaccaagatgcctttgttgttttaggggtgggtcaaattcaagagcgtaaaggtatctgggatttcattgcgatggcaaaagataatccggattggactttcgtttgggttggtggcttttcatttgggtcaattacagctgggtacgatgagctaaaaaaggttttggcaaatccgccggcaaatctaaagttcccagggattgttgaccgtgctgtcattaatggttattacaatgctgcggatgtcttcttgctgccaagttatacggagcttttcccaatgtcagccttagaggcatttagcacgggcacaccaacagtattgcgcgatttggatttgtatcgtgccattattgatggttattacttagctggttcagaccgagaagcgatgcaagcacaattgacggctttgcatgatcaacctgaacttcgtgaagaattgtcaaagcaggccttggccgcctcagaacgttattctgctgactatgtggcagatatttgggaaaaattctataccgaacaagcgagcttgaaaaacaaggggtaagtcaatgacgagacggaatggcattgtttttaccattatgatgttaattggtttggggattttttactggtctttccgtaagattagttggacacagtttgcatcagaagttaaaaacgcaaattggtggtggttgattgtcgcggttggtgcgatggttgtctatctactattagaagcggttgtagttaaaatttttgtcgatgatgcccatgaaaagttgagttggcgtgatgctatccgtgtaccgttggttgaacaattagggaatggtattacgccgtttgctaccgggggacaaccgatgcaaatgattacccttgcgcaggcaggtatcgatcctggacgcgcgggttcgattttgttaatgaagtttgttgtttaccaaggcatgatcgtcgttaattttttgatggcattaacgattgggtatcactacattgcggataaattgcatgcatgggccatcttggtcttgtttggttttgtaattcacttggcggttattgtgggtctcttgttggttatgtactggccaacactgacgcgtacaatggttttgctagtgttcaagccaatcggctggttccgaccagccttagttgaaaagtggaaggatgtcgtggatgaaaagattgataattttcatcgtgagagtgtccgcatgagtcacgactggccggcgctagtcaaagcgattgtggtcacgttcttccagatggcggtttactacctaatcccgtactttattttgttggggctgggagtatcgccgattaatgttgttttggtgacagcattacacgtgctgattgtgatggtgatttcgttgttcccaattccgggtggaactgggggtgccgaagcgggctttgcggtattattctcgcagttcttgccatctgcatctgtattgctattcgccatgatgatttggcgtttgattacctactacctggggatgtttgcaggtatcgttgcctttaatctaaatgcagcgaagagaaggaaataaacatgagtcgagaaagtgatttggtacagattgcacaacgcattcgtgccatgatgattgatgaccgcgaagacatccaaacccgtcattttgacgcgttcggtgtgacggttgtgacagtagtctatgatcgtccgtcgaaggtatttgcggttgaaggtctacgtgataataatcggcgttttgcatttgatgatgccgatttagtcgcaattgatatttatgaagcactgcaagactttaaggaaaccttttaaatagttgtagttagtcgcgattatttaagacgattttatgtttctttaatggaagcgcggtatactgaatattgtaatttttaaggtcgaatggacctagagagaaaatggagcgtaataaaatgcaacgagtagtttcagtcatcaagaaatggtggccagacttcaactcaactgtaggcttctttatgctatcggtcttcttggtatggttgaagacatattgggcatataagacaaacttttcactgggggtacaaggaacgctgcaagagttcttgttgttcttgaacccaattccaacggcgattattttgcttggaattgcgttgtacttccgtggacgcatcgcttactggttgatgttgctaattaaccttgtgcaatcaatttggctgttcgccaatatgttgtactaccgtgaattctctgacttcttgtcattgaacatcatggggtctggtgggtcagttgaaaataacttgagtaagtcaatcgcggggattattcacgggtctgacttcctagtctttgtggatattattgtcttgatcgtccttttgctaacaaaggttattaaggtcgataagacggcggtccaaaagcgttttgcagctttggtaaccgtatttggtgttttgttgatgtttgttggttatgggattgcctcaaaggatcgttcaggacttttgacgcgtacatttgataataactacatcgttaagtatcttggtttgaatgagtatgcagcgtacaacattttcaagacgaagcaaacggcggacgttaagaaagaagctaaggcatcagacctagataagattaagaagtttgttgatggtaataagacgttagaaaattctgtttacttcggtaaggagaaaggtaagaacgttatcatgttccacttggaatcattccaacaattcttgattgattacaaggtgaatgatgttgaagtaacgccgaacctgaatgcgttctaccatgaccaaaacacattggcgtttgataacttctataacgaagtaggtcaaggtaagacggccgatgctgaaacaatgttggaaacgggattgtttggtacagcttctggatcagccatggttaactacggtacatctaatacctaccaagccgtacctgctatcttggaccaaaagggatatacgactgctgccttccacggtgacgtcgcttcattctggaaccgtgataacacgtacaagtcttggggatatgattacttctttagtaagccatatttcaaggatgcggataacgcaaactacaatattggttatggtatgaaggataagattttcttgcaggattctgctaagtatcttgaacaactaccacaaccgttctattcaaagattattacagtgacgaaccactatccatatgacttggataagcaaaacatctcaattgagaagaccacgacgggcgataagactgtcgatggttatgtgcagacggcacgttatcttgatcaagcattcggtgaattcttggcttggatgaagaagtcaggtttgtacgataactcaatgatcgttttgtatggtgatcactatggtatttcagagaaccacccagcagcgattgcaaagttgatgggtaagagctctgttaatgcgtatgacttggctaactggcaaaaggtaccattcattgtgcacgcaccaggattgcaaggtggtattaaccacacgtacggtggtgaaatcgatgtgatgccaacgattttgcacttgcttggtgtttcaacatcaaacaatgtgcagttcggtcaagatttgttagcgccaaaccgtaagcaagttgtgccattccgtaacggtgactgggtatccgctgaatacatgaagtatggtggtaattactacgttacgacgactggtacaaagattaagccaaaggaagatccacgtgctaagcaaattatcgatgagacacaagcgtacgttgataagatgctgacatactcagatgatgttcaaactggcgatttgctacgtttctatacgcctgagggattcaagaaggtcgataagaaggattattcatataagaagtctgacggactcgcgctcttgaagaagatggataagcaaagtgatacaactttgattgatcagcacaaccacacgtctacaatgggtgactatgtgacggatgcacctgaattgggtggacaaccacaaacaattcaacaagctgtttcaagtagtgaatcttcgagtgaagagacgccaacagacgacgcagcacaacaataagaatgaaagcacctcagcacttgctgaggtgctttttgtgtctatggattgttcggaaaaattcgatataacaaagtagttgacgaacgttcgtggatggggtatattatttaagcactcaaatgagcagtacgaaatgtactgaattaattggttgtgattcattaaaaagaagttcaaattggttgttgacaatcgtttgagtcttctgtaatatatattaagtcgtttcggggtatttcatacttatgaacgacgtatgaaaattgattgaaattagttgttgacatttcattctttcttctgtaatatagattaagttgtcaaggcgacgacgtaggtcattgaaaactgaatatcgtttcgatgaaacaaatgtgtagggtcatcaagctaagcttgatgcaaaaaacatttgcgaagtcaattcgctagtaaattcgtttaacttctgttaaacaacaaaaattgagttatgggttttgaaagtttttcggtgtagcggcaccttgcggtgtcgaaaaaacctgtccataatcttgacagcagcgccactttcaacgaatagtgacttcacgtcagactcgttaatcttcgccaacacttgcttcatttgctcaggcgttccctgtgattcagcgttaatttcccaaataaacgccggcttgatgccgtaagcctttgagaagtacttgaaagcaccttcagacgtcaccaacaaacgcttatcttctggtacatccgcgaacttacgttgggcttcctcgtgcaaggccaacagcttcttttgatatgctgctgagcgcttttcaaaagcagctgcgtgttcaggatctttttccttaagaacagccgtaatcgtttgcacgtacttgataccgttactcaaatccaaccatgcgtgtggatcagtttcttgttccttaccggcagccgttagatacattggctgcactagctttgatgccgcaaatacttctttgccatcacgcttgttagccgtttccgtcaacttcgtaaaccagccatttccaccagtttctagattcaacccattgtggaaaataacattagcttctgtcgttgctgtaatatcggcggtcttaggttcgtattcgtgcgggtcagtaccacgcttgacgatgctgtataccttaacgtcatcaccaccaacttgctcaacgatgtcttccaaaatcgaattagttgttacaattcgcaactcaccactagcctcagccttttgatcatcacgttgtgagacgaaccacgccagtcctcccgccacaacccccaatgcacctacagtaatcgcaatcttcttaaacactttgcttcccccacttagtcaaaaatccttgtttcggcgacacgacaaacgatactaaaaacataattgctgccatcaacacaatagctggcccagatgcccaattcattgtgtatgacaggtacaaaccaataactgatgcaacagccccaactgatgccgcaataactagcatccattgcaaacggttattccacaagaatgcggtggctgctggcgtgattaacatagcaacaatcaggataatcccaactgtttgcaatgctgaaactgtaaccagcgtcagcaccaacatcaaaccatagtgtagatacgccgtttgcaagccatacgtctttgcaaacgtttcatcaaatgatgtaatcaatagctctttataaaaaatgacaacaaacagtacaacaatgaccaacacagccaccgttgacatcaaatcacgatcagacaccgcaaggacgtttccaaacaaaatatgatgcaggttcgttgatgattccgccatcgaaatcaagatgaaccctagtgcgaagaatgctgagaagacaatcccgattgcggtatcatttttcagcttactattcgcagcgactgcgccaatcaataacgccgcaatgacaccaaatgctgctgcaccaaccatcagattaatacccaacatgtaggcgactgcgactcctggtaggacactgtgtgaaatggcgtcacccatcaacgacataccccgtaaaataatgaaactaccaataatccccgacatgacgccaaccataacagacgccaacaaagcgctctgcaaaaagttatagtgccccagtgccgctaaaaattctccaatgctggccatccgttacgccccctcagatttattaaacaaaattgcacccaaatctgctgaaaatgctttttgaacgttagcttggttgtaaacttcagcaaccggtccgtgcgcaattaccccgtgattcataatcagcagttcatcaaagtatttcgcaaccttattcaaatcgtggtgcaccacaataattgttttgccgttatcacgccacccctttagtacacgcatgatatcctcttcggatttcatgtcgataccaacaaacggttcatccaaaataacaacttctgcttgttgcacaattgcgcgtgccacgaacacacgttgcaactgtccacccgacaattccccaatttgtcgattcttgaattcagtcaaatgtacctgtgctagggcttcatcgaccaattcactttctttctgcccagggcttttgaataatcctaacttgccatacgtacccgttaagaccacctcaaaaacgctgatcggaaacgttaaatccagcgccgcacgttgctcaacatacgcaactttacgacgtaccattttaattggccgactatcgattcatgcgctccccgtacgacgtaccaatccaagcgcccccttaattaaggttgatttacctgcaccgttcggaccgataatacctgtaatcttgcctgggctaaacgcaacagacaaattttgaaaaactggggttgctgtgtaagcaaccgttaagttatcaatatgcaacatcttgttccctcctcattcaatgttgttcagatgagtttgcatctcatcaacctcacaagattatccgattaatcggaacaagacaatagtttttctgcgattgaaaatttttagtaatagaataacaatattttgtcatgataaaaagttaactatcaacaccctgaacaaagtaaaaaacggccctgctaatgcaggaccgtttcgttaattattcaaatatgcataagtggtttttgccaatttttctactaaggcaatccccgcctgttcgctggtattgccactcgttaataccgcaataacgtagtcactgttgtttgatttaacatgcccaatcgaattaataatccagccattagaatcttccagccaaccattctttaatgacaccgttgcatcactaccaacgccggcgcttacaccccagttttgacttgaagcgacattgctcattaaatcagcaatatatgactgacctgcatctggcagaactgagctgtcataaaatatgttacgcaataatgtcacttgatcagatgccgtggttaaactatagccccaagctgattcatccattgcagaatctgccatgcctaacttgttgaacaacttatccggtgctttatacccgccctcatcttctaacaaagccgttgttgcatcattatcgctatcttcaatcattgccgtcgctaacgttttttcattaatcgacatgttcgtttgatcactcgtatgttgcgcaatcaaattggataacacagctaccttaacaacactggcagttttaaactggctgcgtccagatgttgtataagtggccgtcacgcctgttttcttatcatagatggcaattgttgcgtctgcattggtagactgcgtgtcagtcgcccacttcgcttctaagtcacttgcttcacttgaggcagtccgcttcaccgcaccgatagcggtcgtcacacgccgtataacgccactaacggacatcgaatgcccgtccattgtcatgccaatcaatgatccccctatcatgatagccgccaccaaaagcgaaacccaaattctgcgtctgcgctggcttcgccttttatctgaccgatccataatttttccttctctctatatcaaagctgctaaggcaaacagctactgtgataactgcaattttaaaccgtcagacttaatttaaactttcaacagcgcaaaaaaagacgtgataccgaagtatcacgtcttttttaagaagggcgttaattacttaacagtaacaacggcaccagcttcttccaacttagccttcaattcgttagcttcgtcttctgaaacgccttccttgatagctgaaggagcgttgtctaccaagtccttagcttccttcaagcccaaaccagttgcttcgcgaactgccttgataacttgaaccttagctgaaccagctgaagtcaactcaacgtcaaattcagtcttggctgcttcggcaccaccagctgcaccagcaactgcaacaggggcagcagctgaaacaccaaactcttcttcaatagctgaaaccaagtcagccaagtccaaaatcgtagcttccttcaatgaagcgatgattgaatccttatcaaatgccatgataattaatctcctcgtttatttgcctatgcggcgattttatttgtttgggcaatgcccgggtaaacctgcataacgccaagcggatgcttaggcttcagcagcttcttcctttgcgtctgacacagccttaactgcgtatgcaaagttgcgaacaggtgcttgcaacgttgacaacaacattgacaacaaaccgtcgcggtctggcaaagctgcgtacttgttgatatcttcaacagatgcaacttgaccgtcaacaacaccacccttgatttccaaggcttcgatgttatcagcaaacttcttcaaaatgcgtgaaggagcgattgcgtcctcgttagagaatgcaacggctgatggtccgacaaacaagtcgttcaagtcagtcaattcagcggcttcagcagcacgcgtcaagatcttgttcttgataaccttcaactcaacgccttctgaacgcaattctgaacgcaagttgttggcttgttcaaccgtcaacccacgcacgtcaacaacaactgcagatgcggctgacttaaacttgtcagcaacttcttcaacttgttgtgccttcaaagcaatagttgcttcactcatggtaatgttcctcctgttaagattttgattcgtaccaaaagacccccagcacatactgcaccgggggtcaaaagtcgcttacgcgtttttcacttcctcggcgggttattaagtcttacgacacctgcgtcttaggtagaatcgatttattactcgaactactttatcaggtagtcgaggaagtgtcaacatgaaaagctaactttgatctagaaaaattctaaattacaaagaagcgatatcgatgttaacagcaggtccgaacgttgaagcgattgatacgtgctttacgtatgcacccttaacagcggcaggacgagccttcaagataacgtctgacaatgacttgatgtttccagcaagcttgtcggcgtcaaatgataccttaccaactggtacagcaacgtttccgtcacggtcagtacggtaagtaaccttacctgacttagcgtcagtaacggccttagctacgtcaaacgtaacagttcccgtcttagggttaggcatcaatcccttaggacccaatgcacgtccaacacgaccaacttgggccatcatgtcaggcgtagcaatggcaacgtcaaagtccaaccaaccgtcagaaatgcgttgaaccaagtcagcagcaccaactacgtcagcaccagcttcttcagcttccttagccttatcaccttgagcaaagaccacaacagtttggtccttaccagtaccgttaggcaaaacaacggcaccacgcaattgttggtcagcttgacgagtatcaacgttcaagttgaacgcgatttcaacagttgcatcaaacttggcaaagtcgatatcctttaccaattgggcagcttcttcaacagtgtacaacttagcactgtcaatcttttcagcggctgccaaatacttcttaccatacttcttagccatggtagctattcctccttgcaaatgcggtcaaacggtcattgacctcccgcttgatcatgcttagtttcctacgcgatccgtacggaacccgttaattagccttcaacagtgaagcccattgaacgagcagtaccttcgatcatgcgaacagctgcatcaacgtcagccgcgtttagatcttgcatcttagtttctgcaatttcacgtacttgtgctgcagtaaccgtagcgaccttcttcgtgttaggctcaccagaacccttttcaacaccggctgccttcttcaacaaaactgctgctggaggcgtcttagtgatgaactcgaatgaacgatcttcatatacagtaataactactgggatcaacaaaccaccttggtcggcagtgcgagcgttaaactcctttgcgaatcccatgatgttaacaccagcttgacccaaagcaggtccaactggaggtgcaggggtagccttaccggctggaatctgcaacttaacaatgcttgaaactttcttagccacgattgtttcctccttcgtgtttgtggtgtaatggcgcgtttcgatttacgcctcccacatatgcgtattgccacacataccagattataataacaaaacgcctgacttttgacaagtcaggcgttcactaaatattcttaattttcgctgtttcccattaaatcaatggttgcacatcgttaaatgagatttcagttggcgtttcacgacccaagaaatcaaccaaaaccgttacttcttgcttgtcgttatcgatagccgtcacttcaccttgcatacctgcaaatgaaccagcaacgatcttaaccgtctcaccaacttcaacgttaagctcagttaccttacgctcaacgatgttcatacgttgtagcatgtcgtcaacttcatcaggcaacaatgaaactggctttgaaccaccaccgtgggagcccaagaaaccagtaacacctggtgtgttacggacaacgtaccaagcctcgtcggtcataatcatctcaaccaaggcataccctgggaaatcattttccttgatgatcttcgtctcgccgtccttctcaacttcaacttcttgctcaggcacgataacgcggaagatgtagtcagtcatccccatcgtttcgatacgtgattccaagttggccttaaccttgttctcgtaaccagcgtatgtgtgcaaaacgtaccattgcttatcgtatgactcaactgccatgattgcctcctcaggttatacctgtattttttgtaaattaaaaaccctcatgactgagggttttattatctgcgtttcgatatttttattatatcgcaaccggcttacttagacaaccaagtaaccccttgctcaaatacccagtcagcgccaccgaacaaaacggcgaaaaacaaaccagtcatcaaaacaattgacgtgtcacggacgttttcactcaaagtaggccaagtaaccttcttcatttccgcaacaacactagccaaaaacttcatgtcatgtactcctgtatccagaacggtttagccgacctggtgcttacatcgtctcgcggtgcattgtgtgttgtccgcagaacttgcaaaacttcataacttcaagacgctcaagacgatttggcttcttcgttaccatatagtttcgtgatccacagacactgcacgctaaagcgactttctttgctgccataatgtgtctccgctctatctattttctcatttaatctattgttaactataccacaatcactaaactcagtcatcatacaactcgacggaaagtttaatctgaatctggcggcgcatcaaatacccccatgattttgatcgatgcaacatctccgcgcattcctccaccttgtaacctgataaccataactgcaaaaattgctgttctttcggtgttaattttgatgctattgcttgcaacgatgctttaatatgctgtgattcttcataataaatcagcgtagtttcttctaatcgaccaccatttgtatgcttttcatcttccagcgcaatagtctcaagcgatgaatcgactcgatactcaagtcgccacacttgttgcgcatggtgacgaagtgccttttcgtaataggcaatcagcgtcggccacgtgaaaattcgtaacgacgccaacgcccgatataaaacgtactgcgcttccgaataccagtcgttcggctttatctgggtatcttggcgtgtatattcgcgccaaatcagaccacttagttgcccactcagcgtttgcatggcaattgtgtcgccgttcttcgctgatttcatgatgtcttctatattgtctggcactcgcttcaccatcatcaagtcctccttgtgggttaccttatctcatacaatgccacaagttggttggtatgccatgattatgcaaaaaaggtactatctcggttcatcgagatagtacctttacacataatctttattttaaagtgggttgcggctattaaatgcttgatagatgagcaaactagctgctacggatgcattcaaactttgcacgtgtccaaccattggaatcgtcaacgtctcatcaaccgtcttcttcaacaatggtgaaatacccttaccctcgttaccgatgataagtgcagttggtccagtagcgtcccaacgacggtaatccttaccatccatatccgtgccaaagacccacaaaccgcgttccttcaattgttcaaccgtttgaaccaagttggtcacacgcgcaactggcacgtgctcaatcgcgccagtagacgtcttcgctacaaccgaggtcaattgcacagcacgacgctttggaatgatgataccgtgtacgccggccgcatcagccgttcgcaagatcgaacccaagttgtggggatcttcaattgaatccagcaccaagaagaaaggtgcttcgtccttttcagctgccttagcaaacaagtcatcaatcgttgcatatgcatatgcggcaattgataacacgacaccttggtggttttgaccgtccgtcaattcatcaagcttagccttgggcgcatcttggatgaccaagccacgcttcttagctagcgtcatgacttcatttcgaatcttgtctgtcaaaccagtttgtagccaaaccttgttaatttccgtttcacccttcaatgcttcaacagaagcgtggtgaccaaacacaaattcagtttgtgctgcaatatcctcttggtctgactctggtcgttctgcacgctttgcacgtggttggcggtcacggtcgttaaaacggcgatccgccccacgacggttattattgcgctctggcttaccgccacgctcgcgcttgtttcggttattactttgttgtgccatttgctctcgttcgtccactttctacttgttcataaacccaggcaataatctcatccaaacgggcttgttggtcgcttgctgccaagtagccaattagcgcctcaaatccagttgaaatgcggtacgtaaccacgtccgtattctttgccttcgtatgtgagtttgcattacgcccacgcttaaagtaggccatctcttcttccgtcaataggtcatccgtttccatcaacgcaaacaaagctgcgtgcgccttagctgacacgtagttctttgattcacattgcaaacgggctggcttggtaatccctttggctagcaaatgttgacgaatgtacacttcgtacaccgcatccccataataagccaaatccaagccattcaattgctcataattaatcttctcgttcatgcttactataataacagaaaaaccaggccaatgacctggttttacttattatgcttctacaacatgacgaacaaatggatcatctgacaatccttgctccaagataatcgctgcccaagccttagctgagtgaaggctgtggtccttgaaattaccgcactcacgaatcgtggttgcgggcacatcatcccaagtaatctcatcacgaatcttgcgcaaaacgcgggtgaatgtttccgcaagttgtgttggcgtatatgtttgccaactgatgacatgaaagccggtacgacatccgaatggtgaaatatcaataatgccatccaactcatcacgaactaggctcgcaaacaggtgttccaatgtgtgaataccagctgtttcaatcgacgtttcatttggttgtaccaagcgcaaatcataatttgcaatggccccaccagctggaccggcttgttcttcaatcaagcgcacatatggcgctttaacttgtgtgtgatcgagtgtaaaactttcaacttctgccatgttattttccctccaaataagatacaggcttcttcacttcaacctttgtgccgtggtattggttcttaatccacttttgtactgctgggtcgcgatatagcgccaccagtttcttgtacgttttgttgttggcctgtgattcacgcgttgccaaaatgttgatgttaccaatcgtgcctgaattgattgactcatgataaattgaatccttcaaaacattcaaaccaccggcttgtgaaactgaattcgaaatcagtaccgccgccactgagtcatcttgcttaactaacgacaccccggttgtatcatcaatttccttgaatttgaaatgatgtggattatcagcgatatcagccacacctgacaaggctgagaagttcgccttcaacttaatcaaaccagcgttagcaagcaagcgtaacccacgggccgcgttggcattatcgcgcgcaatcgcaatcgtgctgccatccggaatatcactaaccttgtgataatcctttgagtacacacccatcggctcaatataagtcgtgccaagtgcggctaacttctccgtatcggtctgtttattgaacgcatggaaataatcatatgattggaaggcattcacatcgacttcacctgaagccgtcgccttatttaaggttcccccatccgtgaactctttcaccttaatttgcacatgcgcctttttcgccgccgatgaatcagcaatatgacgccaaatttcagcatctccagtgactgatccaaccgtcacctttttaaccgtcgccgcctgaattgacgtcgttgtcgctaacaccgtcccagtcactacgaccccagcaatcacaattcccaatctcttaaccatttcgcctacccccaaacttcatccgcaatgtgcttgatgaatgataacttcgtccactcttcttgttccgtcaacgcgtttccctcttccgttgaggcaaagccacactgcgtcgatagtgctaagttttctagtggcactaacttcgctgcctcggcaatgcgattcttaattgcctcggccgactcaagcttaggagacttacttgtcaccaatcccaacacaatcgtgacgtcttcgcgaccttgccagatttcaggtaacggctcaaagtcacctgagcgggcatcatcgtactccaagaagtaggtgtcataatgcaattggccaaggtactttgctaccggggcataaccaccttcgaatagatacgttgacttgaagttgcctcggcaaatgtgcgttgagattttaaaatcttctggcaagtcatccaacgccttgttgatgacataaacactgtccgttgcaatcttttcatacttagcacgctcagccggatcattcctgaactcgttcaacttgctaatcaagaaggcccaggtcgtatcatctagttggacgtagcgactgcccaaatcataatagtgttgcaacgtgtcatggtacgcttgcgccaagtcatctagataggcttcccagctgtcataaaactctaaggcccggtctgaacgaccatcgcggaagagcaacgttggcgctggaatcgttgacttaggttcagtcccttctggcgcaactgacttcaggtaggcgaagtcttcaaagaatgggtgttctgggttaaaagcaatcttgccagtcaattggacgttatccgttcgcgttttttcgccgtggaatttgtatgaatcttcctgtgtgtagcgctcaataccggtaaggccccacaaaaagtcgaggtgccaccatgaacgagcaaactcaccatccgtgacatccttcagtccgacttcatgttggtgaaccaccaagtcatgaatttcgtcatgttgcacttgaataagcgtttcgtggtcgattgtcccagctgcataatctgcgcgtgcttgcttcaatgctgctggacgtagatatgatccaacctggtcaaagtgataacgcgccttagttcctactgtcataatgtttaatctcctgttgtttaaaacttaatctgtcgtaactgtcatttttgtctggcccgctgccagttccaaaaatcacattcgactttgaccaagcccctcaccaacaaaaagacatcggtgagcggtgacacatagatattgcatcgttccttcctcactttcttcaactatccgtaaacaaaaaacgtcccgtagccactacagctacgggacgttttcacgtgttaccacccgggttcaatggtcctcaaaaataggaaccatcctctttcagtacggtcgtatgccgacgatacctaagcgcaataacgggcgcacccgagtgacgttcacactttgctcacgtcattaagactccaagaccattttccaattcgcgcgtccgttaattcacaccaaccattaactctctgggcgacgcttgaaaagtacttatctcttcctagtcgatgtttgtatcttaaaactaaaattagaaaacgtcaatagttttattaaaaataaattagagaaattccataccgccatcaaccatgatagattgaccagtaatataagctgctgctggtgacgcaaaccaggcgacaacttcagcaacatcagccggtgtcgcttctcgtcccaaggcaatttcagttaaaacgtttgcttgttgttcaggcaccgtcacctgcttaatcgccgccgttcgctcatcaatcgcatcccgcaatggtgtgcgtactacgccggggttgtaggcgttaactgtaatttgatccgccgccaattccttagcagccgattgtgttaagccacgaataccaaactttgatgccgaataggcgctttgcaacgctgatgcctccacaccagccagcgaggcagcgttcacaatgcgcccaccatgtccttgctccttaaagcgcgtcgccgcggcctgaatcccccagtaagtgccctttaggttcacatcaagaatccgttcaacatcaaccggatcagcatcaacaaacgcatcaatcactgcaatcccggcattattcacatacacatccaactcacccaagtcagacactgcctggtcaaccagttggaacacctcatcccggtgcgctacatcgacttgataaaacttagcttcatagcctgcctcaaccagtgcgtgggcaacttcttctccagtaacgctattaatgtctgcaacaccaatcgcaaaaccatcttttgccaatctgaaggcaatactttcaccaattccctgaccagcacctgttacaatcgccaatttcgtcataataaattccccctccgcatgcgtacacaataaccccacgcacgcaaaagttcaatagttttattaaaaatcaattagaaaaacactcaacaaaaaacagccacccagcaataagccaagtgactgttccaaaaacgattaattatgcacgacgccagcgggttccttgtggcgtatcttctaggataatgccacgagcagccaactcgtcacggatttcgtctgaacgagcaaagtttgatgtctcacgggcagcatcacgttccttgatcaatgcatcaacatctgcatccaacaaaggtgcttgctccaaaccgtcaacaccgaacacgttcatcaagtccttgatttgcttcaagacaaagttgaccgtgtcagtctttacttcttcagcttgtgagtacaagtttgccaattcaatcaactcgtaaaccgccgtcatagcgttttgtgcgttgaagtcatcgtccatggcctcgacaaaggcatcaaccttttcttgtgcctttgcttcgatatctgcatctgaaccttcaactgctgatcccaaacggaattgcaagttgcggtaaccagtgcggatacgctccaagttacgggcagccaagtccatgttcttttgtgagtaagcaattggacgacggtattgcgtcgtagccatgaagaaacgcaaaaccattgggtcatcaatttgttgcaacaattcgtgcaccgtcgtgaagtttcccaaagactttgacatcttttcattttcgtcaccaaccgtaacgaaaccattgtgcaaccacttctcaacgaacttctcaccagtgtgagcttcagtttgcgcaatttcgttcgtgtggtgtgggaaggccaagtcaattccaccaccgtggatatccaagtggtttcccaagtacttcgttgacatcactgagcactcgatgtgccatccaggacgtcccttaccccaaggtgagttccaagcaatggcaccatcgccgttctcacccttccagacagcaaagtccattgggtcttccttacgtgccaattcaccgtcatccaaacgaccagcggcgttagattccatttcagccaagtcttggtgagccaagataccgtatcccttgaacttcttagcacggaagtaaacgtcaccttcagactcgtaagcgtaacccttcttgatcaagtcctcaacgaactcgataatctcaggaatgtgctcagttgcgcgagggcgaacagttgcaggcttaatgttcaatgatgctgtgtcttcgttaaaggcatcgatgtacttgtcggccaattcaggaaccgtaattccttgctcagctgcggcagcaatcatcttgtcatcaacgtcagtaaagttagaaacgtagttaacttcgtatccgcggtactcgaagtagcgacggatggtgtcaaacgcaatcgcagaacgtgcgttaccgatgtggatgtagttgtagaccgtaggtccgcaaacatacatgttgatcgtcttctcgttgatgggcttgaaatcttccttttgcaagctcatcgtgttgaacgtcttcatcattgtgatttaccccttttagtttgtataagccaatggtaacatgacgacaaaaaatccctaaacaatatgcttatagtcaggtgaacaggtaaccatttaattatcatattctcctaatgcatcacacttattttatcatagtaagtcaagttttttgcggtaacttttgatacatcgtcattatccgagaaaacggatgaaacagcgctatgacgcacataaacgtcgtcacacaatgcgcaaaatcaaacgataatccggccaaccaataactccaaattgcgggccaattaaatccaccaaataagaatggcgcttgcaagattgtcgtccaaaatccgtaagttaaacagaagactaggccaacaatcaacgccatgcttttttcatcagcaacatgccgactaccactggtaatcaataccaaaccggcatacaaaatcagttgcaccatcaccaccgggtgcatccccaacaacaatcccgttaaaatcacagcaagacttgccgctggcaaggcaatgcgccagccaaaataccaagcaacaaggatgaccaaggcggtgaacggggtcacatttggccatggatgcacgaacaggcgcgcgacaaccatcacggccgtcaacacgcctgtcatcgccacccaatgtagcgtttttgtcattagaactgcttcaactcaaaggtaatacgatcaccagaatgcaacttcaaatcagcgggcgcttcactggtctgctttccatttaccgtataaacccagtattggttcttcacttgattctgtgcacgaccatcgatttcagtaataaacccatcggccgtgactgacatctttggctcacgcttctcgttttgggccaaatccaaaagcgtttcaccctttttcaacgtcactttgaacgtcttctctttaccatcatgcttcacaaccattgtcacatgacgttctgctttcgattgcgttgtttgggcatctgtgcggctttgccagtgttgcataccaaacagtgtcccaccaataatcaaaaccaacgcaatcaacaacatcaaaactttattaattactcgcatctctctgctcccgcgttacttaattgggcatgcacccgtttcacaatcacttgaatcaaccaagtccatcaacttatcttcgctgtgtagcgcttcatagactgcttgcacatcgccgaatactgatactgaacgttcagcataatcttcagctgaaattggttcctttggtgcttgcgcaaagccgtgtcctgagtaaggcaacattgacgttgacttaatttgtggggcatattgacgcaacatcttagccaacaaaggcttttcatcctcttggaacgtaatcgtgcagctaaccgaattgtcagcccagtacttttgcaagaacgcttggttagccaattgctcggcaacgctcacttcacctgctgacttaaagccagggtaatcagccgaagcagccttaactgggaactcaacaaccattgtgttttctgagtaaacatccggttcgatgtggtaacgagccgcttgcaacgccttcaacaacggatccgtatcttggaaacgaatacgttgaatcaagtgatcagcatagttaaagtgcattccttctgaaacacccgtcaactttgagaccgtacctgatggcttaaccgtcgtgcacttcactgatgggttgcagtgcaacgttgctgagtattgtgcatcagcttccttaactgcttggtacaaacggtcaacttcattaatcaactcttggttgtagattggtgtgtctccatcccagcccgtcacaacaggtgcaccgaatgacgtcaaaacccaatcttgaatacctgacaaagacaccccgatacgacgattcttgttgataatttgacgtgaaatctcccaatcatatgggctaaatgttacacgcttagcaaaacgcgctcccaatgcaacgatgcgggcagggtcaaaacctagttccatcgcaacatttgggaagacctcaaacaggttgcaggcttcaccgtttgccaaagaaatttcaccacatgggttcgttccttcaacatcggcatcaatccctggttgctcactatcagccaaacggccgtagttacgcaacaaatccaagttaacaaccccaggttcaccattttcagcaatggctgcggcgatgtcatcgtattgagccgtgtcatcagccgttacgaaaacagaattgttagatgcccaacggtggtggtagagcttttccttgtcttgcttcatcgcaacgaaggctgcatcatcggcatccccaagcgcaatttcagcagaacggcgtacaccaccagaaacaactgtcttaccaatcaagttcgcaatgtccgtgcaatcaactgatgacaagtgctcacccaacgtgtcgttcaacaagtcgttcacatcttgaatcaactcaatcaatggggctggaccagaagccacaccaccaaagcccttaatcttggcacccttggcacggatagctgaaacatcataaacaaccgcacgcttcatgtcttggcggaagtgacgatcaatcaaatcagccgtcatcaagacccaaccttcacgtgtgtcaggaaccgtcacaacatcggcatccccaaccatgatttcagttgcgttatctgctcctgcaatacgggcttcttcatacgcatcagcctcagggttaatcacaatagctgcatcaaccgtttgggcaaccgctggcatttgagcgacattcttttgcgtcacagaaacaccaacaccgccccccttcatcaattggtcgaacaagaaggcaaatggcattgatgccatgatttcttgcttgtctgcatatggtagcacaatgtggctctcaccatatgcttgtggacgcatggccacaaaccagcaattgttcaacgcatcaccgtgcgcctcttgataaggcgtccctgaaatccacaagttacgaccagatggcgttgcagacaatgagtaaatcgcacggaacaattcctcggcttcgatttgtagcgcatcaatatcagcaactgacgctgtaccttcttgcaaacgtggatccaagttgatgtttccttcgattacacgcttaaccgtctcatgccattcttctgtacgtcccgctgcatcattccatcgtgcatacgtacgcttgtaggttacccagcccaacgttccccagtgtggcttaatgttcgcaattgtttcggcgacaaacgcgtctgataacttaatagaccccatttcaatacccctttttagtaacatttcgttagtatacgaacattactcgttctttgttgtgtctattatcggaaaaataaatacaaacgtcaaatgtataaatattcctaactattagtgaatgacgcgcataatatgcctatatagtgtcgttttgttaatttatatacaaatgtttggacgcaaatttattcctatacattcgtaaccgataacctaacgttctgttacattaaggttttatcattttgtcgattgtcaaaatatacacaatacattttcgttacaaaaaaagacctgtttccaatcaggaaacaggtctcgtttcttataacgttttacttccaccactcatcaaaaacagtcactggtgattggcgcttgtgctcagttgtcgtaaacaacttttcaatttggatggcatccttttcagcaacatccttaccttctaggtagtcatcgattgcatcgtaagtcacgcccaatgccacttcatctggtaatgctggacggtcttcttccaagtcagccgttggcgtcttttggtacaagtgttcaggggcacccaagtaagccaagatttgacgaccttggcgcttgttcaaacggtacaacggcgtaatgtcagccgcaccgtcaccaaacttcgtgtagaagccagccaacgcttcagctgcgtggtcagttccgacgacaacaccgtgcatcgcaccggcaacaccgtattgcgcgatcatacgctcacgggccttgatgttacccttgttaaagtctgacaccgtcacaccagctgcttcaagttgcttgaccacaccttgcacagagtcttcgatgtttacacgaatcgtttggtcagcttgttgccaagcaattgaatccaaggcatcttgctcatcggcttgggcgttgtatggcaaacgcatggccacaaacttgtagtccgcatcccccgtctcagcacgcaactcttcagctgccgtttgtgacatcttaccggcaagcgttgaatcttgaccacctgagattcccaaaaccaatgtcttcatcccagtcttcttaaggtaagccttcaacaagtcaactgaacggcggaattccgtttcagggtcaatggttgcttgaacacccaacgtatcaataatcttcttttgcaaatcacgcatgatgacgctcctaattctcttcgtattcttttgcgacttcagagacgtattcacggagctccttaatcaaattcatcttgtgatcccaagcggcttgtgacaagtcaactgggtattcttgtgggttcagatcacgacggtactcagaccatagtgattcaatatgctcagctgtgtaatcgcgaatatcattcaaagctggcaagtcataaaccaattcgccatccacaaatatatcttgcaagattggacgggccgtataatcaacaaccgtcttattcaagtatgggtagtttgggtggaacatgtacaaaccgtctggcaactcacgtggatcttcatcccaaagggcaacataatcaccttgtgacttaccatcagaattacgtgtaatacgccaaacttgcttcttacctgggtttgaaatcttctcagcagttcctgaaatcttgatggtatcgaccatctcaccgttttcattttccactgaaacaaccttataaacaccacccaatgcaggttggtcataagccgtaatcaacttcgtaccgataccccaagtatcaatcttggccccttgcaacttcaaacttgtaatcgtttcttcatccaagtcattcgatgccacaatctttgcatctgggaaacctgcttcatcaagcatcttgcggacaccctttgaaacgtaagccaagtcacctgaatcgatgcggacaccgataaagttaatcttgtcacccatttttttagcaacgcggattgctgatggcacacctgaacgcaatgtatcatacgtatccactaggaatacgacgtccttgtgcgtctcggcatatgccttaaaggcctcgtaatcattacggtaaacttgcaccaaactgtgggcatgcgtaccagagattggaataccaaatagcttaccggcacgcacgtttgacgttgcgttaaaaccaccgatataagcagcacgcgttccccatagggccgcgtccatttcttgggcacgacgagttccgaattccatcagcgtttgatcaccgacaactgaacgaatacgtgatgccttcgtggcaatcaacgtttggtagttaacgatgttcaatagtggtgtttccaccaattgcgcatcaaaaacgcttccctcaacttgcaagattggctcgttgttgaagacaacttcaccttcacgcggtgcacgaaccgtcgccttgaaacgccaatccttcaagtagtccatgaagtcttcatcgaactcaccggtctcacgtaggtacgcgatgtcgctttctgaaaaatgaagtcccttcaagtattcaaccaaacgttctagtccagcgaaaaccgcataaccattttcaaaaggcatcttgcggaagtacatttcgtaaaccgccttgcgctcatgaatgcccttcttaaaatacgtttgcatcatcgatagttggtaagcatctgtgtgcagtgccaaactatcatccggaaatgccattgtcatgacgttcgtctccctaactttcgtaagtatatatgccctatattttaccacaattcacccacctaaacgccagcacacttttttagcactgctcgaaagtaagttgtatactgttatgtggaattatttaattttaataagaagaaagctggtgaatttgttcatggcagaacaaaagtttccttataaggagtctctccgtgtaggtatgttgctagccggtacagccggttacatcgactcatataccttcgcctttcacgataaccgctttgcaagtttccaaagtggtaatctgttgcaacttggtattaatgttgcgtcaggtaagtggcacactgctagtttgtttttctggccagtaatcgcattcttcgttggcgcggttttgaaccaaatcatcaagaaggcgtcatttaagaatgaagtgcaatgggaagaacgttcagtcttcatcgagttgctcggtgtcctatttgtggccttcctggagttagcccacgtgaactcattgattgtgctcagtgtcttggccatcttcatggcgatgcaagctgatacgttcagtaagttgcgcggtatgccttacgcgaccgttttgagcactggtaacttgaagacgttcggtgcaacgttggctaacggtttcttgaaccacgacaagtcacaatttattaagacacgcaatgttggtttggttatcgcctcattcttgtgggctgcgatcatcgcccacttccttggtttgatgattggtgactacacgttattcggtgccccaatcctattggcattcgtttggttcttcgttcgtcaagaccgttcggaaacaaagtaacttttcctgttgacacgtttctcagaatcagttaatatacaaatcaagcattttataagttttaaacaagttgagcaggaaagtaagttacctgaagcatcaaagagagacaacgttcggtgtgagttgttatgtggattgtttctgaaaatggcctgtgattggcgttggtgagcagcaagtctgtaagctaacgacggattggtctacgttacaagacacacgaatcggcaaagcatcatctcgctcactgcccgctcgttgttaaggtctggagtggcaacgctccagatgaagtagaatggtaacacgaagactcgtttctatttgatcatcaatttatttgaatggtcatttggaaacgagttttttctttttctactcacctgtttaaaacaaacacattattgatatgggacatgaactttaattatttgggagatttatttatgaacaaggtatttaagactggtgttgcggtagctgccgcagcgttgactgcatctgttgttttgcctgctacggctgtttcagctgattcaaagactgtaacggttggtatcgtcggcacgtcagacaagggcgtttgggaagaagttgccaagacggctaagaagaagtacggcatcacgattaagacaaaggtcttcacagactacaaccaacctaacaaggccgttgcggatggttcattggacttgaactcattccaacactactacttcttggaaaactggaacaagtcaaacaagaactcagttaaggccattggcaagactttcatcacacctatccgtttgtactcagagaagtacaagtcagttaagaagttcaagaagggtgatgcaattgccgttcctaacgacgcaactaacgaagcccgtgctttgacgttgttgcaatcagctggcttgattaccttgaagaagggtgttgatatgccaacagttaaggatatcaagacaaacaagttggacttggatatcaaggaagttgctgctgaccaaacaccttcatcattgaagtcagttgatggcgcagttatcaacacgaactacgcacaacaagctaagttgaagttgagctcagctatctacgttgagcctgttaacaaggactcaaagaagtggatcaacatcattgctgcttctaagaagaacgctaacaagaagatctacaagcaagttgttaaggcttaccaaacaaaggctactaaggactacttgaagaagacttggggtcaagctgaaattccagcttgggacatcacattgaagtaatcaacttcaccccaccgctttcacgagcggtgatacatattgagattaataaggagagattttcatggctgttattcaactaactgatgtcaacgtgacatttaagcaaaagaatcgagaaattgtggcggttcaaaacgaatccatcacaattgaaaaaggtgatatttacggaatcgttggttattctggggctggtaagtcaacgctagtgcgtacgattaacttgttgcaacgtccaacttcaggttctgttttggtgaacggcactgaaatgacgacgttgagccctgcccaattgcgtgacgagcgtaagaagattgggatgattttccaacacttcaacttgatgagcgaattgacggtgtttgggaacgttgcccaaccattgaagcactctaacctatcaaaggctgagaaggccgctaaggttaatgaattgcttgaattggttggcttggctgaccgcgctgagaactacccttctcaactttctggtggtcaaaagcaacgtgttgccatcgcgcgtgccttggctaacgaccctgaaattttgatttctgacgaagccacatcagctttggaccctaagacgaccaaccaaattttggccttgttgaagcaattgaaccaagagcttggtttgaccattgttttgattacgcacgaaatgcaagccgttaaggaagctgctaacaaggtggctgtgatggagaacggggccatcatcgaacgcggttcattgcttgaaatcttcacgaacccacaaaagcaattgacgaaggacttcattaacacggccactaaccgtgacgaagcgcttgagaaggttaatgagcttttggctgagcaaccattgtcagctgatgaagagcttttgcaaatcgattacgttggtgcagatacggcgcaaccattgctatcaacgatttacgctgactacgctgtgacaacaaacttgttgtactcaaacatggagattttgacgaagacgccagttggtttggccatcgccatcttcaagggaactgactcacaacgtgccacggcgaaggcaagctttgctgatcacggtgttaagattgtcgaacttgctaagggaggacaaaactaatgattcaatggattgaaacgacatttccaaatgtttatcaacttggctggagcggtgactacggctggggaattgctatctggcaaactatttacatgacgattggttcagccttcttcggcggcttgcttggtcttgccttcggaactggtttggtcctaacaactgaaaatggtattacgcctaaccgtaccgtattccaaattttggataaggtggtctctgttggccgtgccattccatttatcatcatggtggtggccttctcacctttgacacaattgattgtcggtaccacaatcggtacgacggccgctcttgtgccattgtcattgggtgtcttcccattctacgcgcgccaagtgcaagtcgctttgttgggtgttgatgccggtaaggttgaagccgcgcgttcattcggtgccacgaactgggacatcatcactgatgtttacctacgtgaaggtcgttcagaattgattcgtgtctcaactgttacgttgattagcttggttggtttgacggccatggctggtgctattggtgccggtggacttggaaccactgctatcgttactggttaccaacgtttccaaaacgacgttatgtggttggcaaccatcatcatcttgctccttatcgtgttgatccaattcgttggtgacttcttcgctaagcgtgcacatcacggataataaacttaagcctggtctcacatgtgttgaggccaggcttttttagtgggtaattgccccttctccgtgtacaataagtgcagttaaatacgtaaagaaaggtggctcatattttgaaattcatcgcatttttaaagtggctcatctggcttgtcctcgggttcttcattagtggtgtgattggcattgtcatcgacaaaagcaatctcatgacgaccatatttggaagccttggcacaacgattgggacacaaatcaacgatatctggtggttcctaccactcgcgctacttaacctgctcttcttccactacgccatcggctggtggggtgcaaaagccggccttgcttggctcctcttattgccatacttgctctacgcggttgtcagcaccattgcccaagggattacctggaacatcacggcattggtttacctaatcggcgctttggtggttgggttgaccgaagagtacatgttccgtggcgctttgtttgcagccttcaagaaagctggggttggtgagacatcacttatcgtcgtatcagccctcatcttcgcggcattccacatggtgaacggtcttgctggtggcaacttaatcgccctggtattccaagtactctttaccttcggcttgggtattttcctcggtgtcatctacctaaagacaagggcgctactcccaattgcattcgcacacggtttctacgacttttcagtcctagcaccagggcatgcattgtttaacatgggtggtattaccaacattctcattctaacgattgcgttaattattcttggtattgtgtaccagaagaagatcgcatagtaaaagggcagctcaaacttgagctgcccttttcgtttacttgtgatttgtgtttagaagctgtcctgcgacctttagttcaccaagggcatcaatagctgtattcggtacaataaccgtgttagcggggctcttagcaacgtctctgaaggcatcaatgttctgagcaaccaaatagtttgcatctactgtactcaagatatcatttgccttttgaatacggtaagcctcagcatccgcggccaaacgcacagctttagcattagcttcagcagttgaaaccaatgcatcattctgtgccttcgtcgtcaactcaatcgaacgcgcctcaccttcagcacgcgcaatcgctgcttcacgttcacgcgtggcattgatttgcttgttcattgattcttgaatctcaggcgttggttgaatcgtatcaatattaatacgatcaacatttacaccgtaagcatccgtaattgaaccaagttccttgcttagcgcggcgttaatacgctcggtcccattcaagacttcgttcaaatccatcgtaccaataatgcctcgcaaatgtgcacgtgattgttgcaccattgactttactgagtccgcgttctcaaacgtaaacttatatgggtccgtcacgtgatagttcagtgacaatgaaataataacttcagcgttatcacgagagatgacactttgctcgctcagacgcaaaggtacttgcgccaagtcaacacggtcaacgcgcgtgataaacggcatcacaacgtgtaatccaggttggatttggcgttgatacttaccaagcacagataccatacccaccatgttctgtggaatgatacgaataccagtaaacacaacaaacgccaatataatcagcaataacacaattaacacactaaataagatcatcattatcccccatttcaaccaacataaccttattacctattacgtcatcaattataacagtatcacccatactaaactgagacgaattgttaacctgataataaataccgtttagctttagcatgccatctgtataattatcgtcagtcaacgtaatgatttcttgcttaaggcgattatcaaaattataagtcatgttagttattacgctgcaacttttctagtgccacagtaccatcagaaacaccagtgacacgaacagaatccccaatctgcaacccatcaaaacaacggtatggataacgctgtcccttgatccagaccttatcagacgttagactccccggcgtcaaatgaaacgtcatatttaaaatgctatcatttacatgtgcgttcataatatattccccctgtaatatcagtaagtttacatacattatagacacatcaatcactcaggtaaacaaaaagcctttaaatcggatcgaccgacctaaaggcaaaagtatacaaaaaaacctcacacattactggtgcgacacaagtgccattcaacctagacttggcttaaagccatcatcgtagcggtttataccatgtaacatgagagatttcattgttttattaattaaccaatgaaattagtcaaccaattccaagataaccattggtgcagcgtctccacgacgttgtaccgtcttcaagatacgagtgtaaccacccgcacggccctcaaagcgaggtgcaacatcgttgaacaagtgttgcaaagccgtttctaccttaaccttgttatcttcagtcgtttgtacgtctgcaacaacgttacgtacgaaagcagcggccttacggcgtgaagccaagtcaccacgcttacccaacgtaatcatcttctctgcagtacgacgaacttccttagcgcgggcttctgtcgtttgaatgcgaccgttgatcaacaaagcagtcgtcaaatcacgcaacatagccttacgttgtgagctagtacgtcccaacttgcggtatcccatgagtatgtcctcctttacttggaattctatcgtttaatctaatcttccttgcggaaccctaaaccgagcactgccagcttttcctggatttcgtcaagtgatttccgaccgaggtttcgtacagacatcatttgagtctctgtacgctccgtcaactcttgtacagagttgatcccggcccttttgagacaattataagaacgaactgacaagtccaactcttcaataggagtgtcggcatgcttgctagttggtacttcttccttgtctaccatcacttgtgtgttaaccgcgcgttctgacaattcaacaaatgagttcaagtggtctgacatgatacgggctgccaatgaaatagcttcagtagcagtcaatgatccatcagtccagatgtccaaagtcaacttgtcaaagtcatcacgttgtcccacacgagtgttctcaacttgatagtttacgcgttcgattggggtaaagattgaatcaattgctagaacgccaattggcatttcttcatgcaattccttattctggtccgctgacacataaccacgtccgcgttctgcagacaaagtcatgtgcaacgtagccccagccgcaacagtggcaatgtgaagatccttgttcaagatctctacatcactatctccagcgatgtcgccggccgtcacagtagcgggaccggttacgttaacttcgagcgtcttcgcttcatcactatcgatgcgcattgaaaccttcttgaggttcaagatgatttgcgttacatcttcaacgacaccttcgaccgttgaaaactcatgcaaaacgccatcaatttgtactgaattgattgccgcaccaggcaatgaagacaacaatacacggcgtagggagttacccaaagtagttccgtaaccacgttcaagcggctcaaccacaaacttaccgtaattgctatcctcttcaaccagcgtaatctttgggttttcgaattcaagcatactgtttgttacccctttcaaagcattgtgtgaactagttgcaactggcaattagacacgacgacgctttggtggacgtgaaccgttgtgtggtacaggagtaacgtccttaattgacgtaacttccaaaccagcagcggccaacgcacggatagcggcttcacgacctgaaccaggtcccttaacagtgacctcaacagtcttcatgccgttttccatagcacccttggcagcagcctcagcagccatttgcgcagcaaatggtgttgacttacggctacccttaaatccaagagaaccagctgatgaccaagcaacggcgttaccttgaacgtccgtgatcatcacaatcgtgttgttgaacgttgcgtggatgtgtgcaacacctgactcaatattcttctttacacgacgcttacgattagtacgacctgccataatcaagtaatctcctttctttacaaattaagaattacttcttcttacctgcaattgcaacagctgggcccttacgcgtacgggcattgttcttcgtgttttgaccacgaacaggcaagcccttacggtgacggataccacggtatgatgcaatttcttgcaatgccttaatgttcaatgagatttcgcgacgcaagtcaccttccaccttgataccgtctacgacggcacggatggcgtcctcttggtcgggcgtcaaatcacgaacacgtacgtcttcagaaaccttagcttcttccaacaccttcttggcagttgcgttaccgattccatatacatatgtcaatgcgatcacgacacgcttgtcgcgaggcaaatcaacaccagcaatacgagccattacgattacctcctatataagatttaaaaagtttttgtgtcaaaatgcaaattatgcaccttggcgttgcttgtgcttagggtttgctgagcaaatcaccatcacacgaccgttacgcttgataaccttgcagttatcgcacataggcttaacagatggacgaaccttcatggtatttacctcccttggattttttatggttgactacttaaagcggtacgtaatacgtcccttagtcaaatcatatggcgacatttcaaccgtcacacgatcaccaggcaaaatgcggataaagttcttacgaatcttccctgacacgtgagctagaatggcggcgccgttttccaattcaacggtaaacatggcatttggcaaagtttcctttaccacaccagaaatttcaataacatcgttggccacgttgctgcctccttagttgtgacattggagaacgtaacaagtaattataacatgctctcttacaatttaacaagaaagcttcccggaataattacgcgttcttcaaattatcaagtaacgtctttacatcagcgaacactacatcaagctcgcgagcaccatcaatcttgtgcaaaatgcccttttcggcatagaactcagcgataggctcagtaagctttccgttaacgtccaagcgattcttaatcacttcaggcgtatcgtctgcacggccacgggccatcatacgatcaaccaaaacatcagcatcagcagtgaagtaaagaacgccgtccaatgaacgaccatcctttgccaacatctcatccaatgccttagcttggtccaagttacgagggaatccatcaaggatgaatccaaccttcgtatcctcttcagccaagcgctcagcaacgatgccgttagtaacttcgtctgggaccaagttaccagcatccatgaatgactttgccttcataccgagttcagtctcgttagccatggcagcacggaacatgtcgcccgtactgatgtgcggcaagttgtactcttcaacaatcttcgcagcttgggtacccttaccaacacctggcaagcccaatagcatgatattcaaactcattttgcttcgaccccttcttgaataaatccaacatattgccgcttcatcatcaatccttcaagttggcgaatcagatcaattgccacaccaatgacaatcaatactgatgttcctgacattccaaggttactatccaacccgaagatgtgtgttgctagaattggtgccaaagcgacaaatcctaggaacaaagcgccgacaactgacaaacgcatcagcaaaccagacaaccacttttcagtggcacgtcctggccagacgcccacaatgtaactaccttgcttctgcaagttctccgcaaccttttcagggttaacctgaacgaatgcatagaagaacgtaaacaagataatcaacaatgtgtaaacaataccaccctgcattgtctgcattgataggtattgcatcaaagtgttgtaccaacctgcgtccgcaaacttacttgcaaaagcttgcaagatagtttgtggcgttaccaacaatgatgaagcgaagataacaggaataacacccgcaacattaatcttcaatggtaggtaagatgagttacctgaaccagttgaacgacgtgtatattgcattggaatcttgcgaatcgcttggttgaaccacgtaacaaacgcgataaccaaaacgaagatcaacaagataccaaccaagaatgcccacccacgcgctgggtcgtcaccttgtaggacgtgttccttgaacagttggtatacacctgctggcacacgcgcaatgataccagcaaaaatcaacattgagacaccttgaccgagtccgcgctcagtaatcatctcacccaaccaaacagcaaacatagttcctgcagttagaatgaaaccgatcaacaagtacgtctccaaatttggtgtcttaaccaaattcacttgactcagttgattgaatccagcggtgattccaatagattggacaaacgctagaacaatagtcaaatagcgggtcacttgattcaacttacgtcgaccaacttcaccttgtttcgcccattcaacaaatcgtggcacaatatccatttgtaggagctgtaccacgatttgagcagtaacgtatggtgaaacacccattgcgaacaatgagtaatttgtaagtccaccaccgctaaacatattcaaaatgctgccgagcccagaatttgctacctcagtaagtgctgccgtgttaatacccggcacagtaatgtaggcacccaatcggtaaacaatcagaatccctaaggtaaagaacaactttttacggatgtccttttccttaagtgagttgagcacggttttcagcattagatcacctcagtcttaccaccggcagcttcaatagccgtaacagcagcggctgagaacttgtttgccttaacagtcaatgacttttccaattgaccgttagccaagatcttaatgccactcaattcgttcttaacgataccagcttcgaccaacaatgctggtgaaacttcagttccgttatcgaattggttcaacacatcaaggttcacaacagcgaattccttgcggttgatgttagtaaatccacgctttggcttacgacggaacaaaggcatttgtccaccttcaaagcccaaacgtaccttaccacgagccttttgacccttttgaccacgtcctgcagtcttaccgtttcctgatgactcaccacgtccgacacggttgcggaccttgcgtgaaccttcagcaacttggagttcattaagcttcattaggttgtacctccttcaaagcaatctatttatgtgcttacttaactacttcaacagtaaccaagtgagcaatcttaaacactgcaccacgcgttgctgcgttgtcaggcaacacgactgatgatgacaccttgttcaaaccaagggccttaacaatcgcacgttgctttggcaaacggtgggcagcactctttacaagagtaatcttaacttgttcagccattttctgcctccttaatctgccaagtgctcaagtgagacctgacgcaattcagcaacttcttcagcgttcttcaatgagttgattgcatcgaaagttgcgcgcacaacgttaattggagttgatgatcccaatgactttgcagtcacgtcggcaacaccagccaattccaaaacggcacgagcagcaccaccggctgccactccagatccttcaacggctggcttaagcaagatgcgaccaccgccaaagacaccatttgcagagtgaggaagggtcgtaccaacagttggaactgcaacgatgttacgctttgcagcttcaacggccttgcggatagcttcaggcacttcttgtgccttaccagtaccaaaaccaacgtgtccgttacggtcaccaacaactaccaaagcggcgaaacgcaaacgacgtccacccttaacaaccttggtaacacggttgatggcaacaacgttttcttcaagctcgccgagcttgtttgcatcgataaaagccatgtttaatttcctccttcccttagaacttcaaaccagcttcacgagcagcttctgccaaagcttgcacacgtccgtggtacaagtaaccaccacggtcgaatacaacaacttcaacacctgcagccttggcgcgttctgcgatcaaagctccaacctttgctgcttgttcagtctttggagcagtctcaactgacttgtccaaagttgaggcactagcaagcgtcacacccgctacgtcatcaatcaattgcgcgtagatgttcttgttagaacggtaaacgttcaagcgtgggcgctcagcagtaccagaaatctttccacgaactcgcgtgtgtcggcgttgacgcaccttgttcttgtctgacttcgtaatcatgttcgtaacctctttttgtatatactcgaaagatataccaataagtaaatcccgagacgttgctcccgggccttaagcaataagcttaagattacttaccagtcttaccttccttacgtgcaacgtattcgttttcgtagcgaattcccttacccttatatggctcaggtgcgcgtacggcacggatctctgcggccaagtcaccaacaaattgcttgttgattccttcaacagtgatcgtagttgaatcaggaacttcaactgtcaagccttcacgggcctcaaactcaactgggtgtgagtaaccaacgttcaagacaagcttgtcgccttgcttagcagcacggtatccaacaccgaccaacttcaaagtcttcttgaagccggctgatacaccttcaaccatgttcgcaacgttagcgcgagtagttccgtgaagtgccttgatacgtccttcgtctgaaggacgagtgaatgatacttcagtaccgtccacagtgaattcgatttctgatgcgatttcgcgagaaatctcacccttaggtcccttaacagtaacgacgttaccttcgcgtgacaattcaacgccagcaggcaaagtcaaaaccttgttaccaatacgactcatcggtagacacctccttgtttagattttatttattaccagacgtaagccaatacctcgccaccaatcttcttggcgcgagcttccttatcggtgataacaccttcggaagttgagatgatagcgatacccaaaccgttcaaaaccttaggtacagcatctgccttgacgtatgaacgcaatcctggctttgaaatacgcttcaaaccagtgataacgcgttgcttgtcggcaccgtacttaaggaagacacggatgacaccttgcttgtcatcttcaatgtattcaacgtcgcgaacaaagccttcgttcttcaagatttcggcgatgtccttcttgatctttgatgcaggtacttcaactgaatcgtggcgaaccatgttcgcgttacgaatgcgagtcaagaaatctgcaattgggtcagtcattgacattgatgtttgcctcctattattaattactgtaaatcagtgttgattactttgagaaaggcatacccaattgagtaagcaattcacgagcttcttcgtcagtgttggccgtcgttacaacaacgatgtccaatccacgaacgcggttaacttgatcgtaatcaatttctgggaaaataagttgctcacgaattcccaacgtgtagtttccacgaccatcaaaggcctttggtgaaactccacggaagtcacgaacacgtggcaatgaaacgttgatcaacttatccaagaagtcgtacatacgctcaccacgcaaagtaaccttagtaccgattgccataccctcacgcaaacggaagccagcgattgacttcttagcgcgagtgataactggcttttgaccagcaatcaattccaattcagcaacagcttcatccaagttctttgagtttgatacggcgtcaccaacacccatgttaagcacgatcttttcgatcttaggtgcttgcatgattgatgagtactcaaacttctcgatcaatgaaggcgttacttcattgacgtacttttccttcaagcgatttgccatgataatgatttcctcctttcacctagaaaattatgccaaagtcgttccagacttcttagcaaaacgtaccttcttaccatcttcaaccttgtaaccaatcttcgttggttcgttagtagaagggtcaagcaattgtacgtttgaaacgtggattggagcttcaagctcaacaattccaccttgtgggtattggttgtttggcttttggtgcttctttacgatgttcacaccttcgacaacaacacggtccttagcagcaatagtcttaacaactactccttccttgcccttgtccttgccggcgataaccttaaccttgtcaccagtcttcacaaacatgcgaggcttcctccttgatttaatgatggtaattacaatacttcaggtgccaatgacacaatacgcatgtaatcattgtcacgcaattcacgcgcaacaggtccgaagatacgagtacctacagggctcttgtcatccttaacgatgactgcagcgttttcatcgaacttgatgtatgaaccatcagcacggtgaactcctgaaacagtacgaacgataacagccttaacgacgtcacccttctttacagtaccaccaggaatagcttgcttaacagttgcgacgatcatgtcaccgataccggcgaacttacgacctgatccacccaaaaccttgatagtcaagatttcacgtgcaccagaattgtcagcaaccttcaaacgactctcttgttgaatcacgattttgtcctccttccgttattggtaagattcgagattaaacgattagataataacggccttctcgacgatttctaccaaacggaagcgctttgtagctgacgttggacgcgtctccatgatgcgtacgatgtcaccttgcttagcttcgttgttttcatcgtgagccttaaacttcttcgtgtacttaacacgcttaccataaacagggtggttcttgtaagtttcgatggcaacagtgattgtcttatccatcttatctgaaaccacgcggccttggtaaaccttacgtgcgttacgagcttcagtcatatcggtctcctctcttagtctacttgttcaattcttgttgacgaatgaccgtcttgatacgtgcaatttgcttacgtacttctgacaatcgagccgtgttctcaagttgaccagtagctaattggaaacgcaagttgaacaattcttccttgtagctcttttccttggcaaccaactcagcttggctgagacccttgatttcgttttgtagatccttgatcttcattattcaccctccacttggcgagtcaagatcttagtcttgactggcaacttgttagatgcaagacgcaaggcttcgcgggcaacctcttcaggaacaccggcaacttcaaacattaccttgccgcgcttaacaggtgcaacccatccgtctggagtacccttaccgttacccatacgaacaccaacacccttagaagtgtatgacaagtgtgggaaaatcttgatccaaacttgaccaccacgcttcatgtgacgcgtcatagcaatacgagcagcctcgatttgacggttagtgatccagtgtgattcagtggcttgcaaaccaaactcaccaaatgtaactgtcttaccacccttggcctcaccgcgcatctttccacggtgtggacggcggtactttacacgctttggtactagcatgttactcgcctccttgcttctttacagacttcttctctggcaaaacatcaccacggtaaatccaagtcttaacacccaattgaccgtaagtagttgttgcctcatcccatgagtagtcgatgtcagcacgcaaagtgtgcaaaggcaccgtaccctcagtgtattgctctacacgagcaatgtcagccccgttgatacgtccagaaacttgcgtcttgatacccttggcaccagcacgcatagcacgttggatagcaccacgcattgcacgacggaatgccacacggcgctccaagtctgatgcaatttgtgaaccaaccaagtgggcgtccaaatcaggcttcttaatctcaatgatgttgatgtggacgcgctcgcccttagcaacaagctttgacaactcgttacgcaatgcatcaacttcagaaccacccttaccaataaccatacctggcttagcagtgtggattgagatgttcacgcggttagcagtacgctcgatctcgatgcgagatacagatgcgtcagccaacttagtctcgatgtacttacgcaacttcaaatcttcgtgcaaagccgttgcgtagtccttcttgttagcgtaccacttagcatcccagtcgcggatgatgccgacacgcataccagttgggttaatcttttgacccatgactcaatcctccttacttttcttttaccacaatcgtgatgtggcttgtacgcttgttgattggtgaagctgaacccttggcacgtggacggaaacgctttagcgttggtccttcgttagcaaaggcttctgcaactaccaaatcttcgcgatctagtgagaagttgttctcagcgttagctacagctgagttcaacaccttgtatacatcttctgagctgtggtttggcaagaattgcaaaattgcaaatgcctctgccacagacttaccacgaacttggtcaagcactaggcggaccttacgtggagcgacacgaacgatcttcgccgtggcgcgtgctgacgtgatttgttcagccattgtattgtcctcctatattacttgcgcttagtcttcttatcgtctgctgcgtgtccgcggaacgtacgcgtagggacgaactctccaagcttgtgaccgaccatgtcttcttgtaccaaaactggcacgtgcttacgtccatcgtaaacagcaaaagtcaatccgataaagctagggaaaatcgttgaacgacgtgaccatgtcttgatgacagcttgcttttctgaagcgttggcttcttcaaccttcttcaacaagtgagcgtcagcaaatggtcccttcttcaggctacgacccattttaaggtcctcctctcgtttgctaaaaacttattaattacggagtgtaagtattgattacttgcccttacgaccgcgaacaatgaacttcgttgaacgagccttcttgttacgcgtcttcttaccggcagtcttcttaccccatggtgacattggacttggacgaccaactggggcctttccttctccaccaccgtgtgggtgatcgttagggttcataactgatccacgaacgtgtgggcgttgacccttccaacgacgacgaccagccttaccccagttgatcaatgagtgttgttcgtttccaacaactccaaccgtggcacggttaacggccaagatcatacgtacttcacctgattgcaagcgaacaagtacgtactttccttccttacccaacaattgtgctgatgcaccggcagaacgggccaattgaccacccttaccaggcttcaactcgatgttgtggatttgagttccgtcaggaatgtttgccaatggcaaagcgtttccgaccttgatgtcggcatcaggacctgattgaacagtcataccaacttccaagcccttaggcgccaagatatatgccttagtaccgtcagtgtattgcaacaaagcgatgttagcagtacggtttggatcgtattcgatcgcaacaaccttggctggaacatcatcctttgtacgcttgaagtcgataatacggtattggcgcttgtgtccaccaccacggtggcgcacagtcatgtgaccgtatgagttacgagcaccagtgtttgactttgattccaacaagctcttttcaggcgtcgtcttagtgatttcagcaaaatctgaagacgtcatgttacgacgaccgttagaggttggcttgtacttcttgatagccacgctaatttcctcctaattagttttcgttgaacaattgaatgtccttagaagcggcagtcaacttaacagttgccttcttacgcttcttagtgtaaccagcgaagcgtccttgacgcttcaacttaccacgtacgttcgccgtgttgatcttttcgatcttaacatcgaaaatttcttcaatagcgcgcttaatttgtggcttagtggcgcgaacatcaacttcaaacgtgtaacgcttttcatccaaaacgctcatcgtttgttcagtgatgaccgggcgcaaaatgatatcgcgtgcgtccattatgccaaaacctcctcaacttgtgccaaagctgattgaactacaaccaacttatcgttgttgattacgtcaagcacgttaacaccctttgcagtcataacagtaacgttttccaagttacgtgctgccaatgctgcgttagcgttatcatcgtccaagacaaccaacgtcttttcgtttacgttcaagttgttcaaaactgccttgaattccttagtcttaggagcgtcgaatgacaatgcatcgacaacaaccaaagctgagtccaaaaccttttgtgacaacactgacttcaatgccaaacggtaaaccttctttggcaacttgtaggcgtatgaacgtggagtaggtccgaagacgataccaccaccacgccattgtggtgaacggattgaaccttgacgggcacgtccagttcccttttgacgccaaggcttcttaccaccacctgaaaccgctgaacggttcttaacggcgtgagtaccttgacgcattgatgcacgttgcatcaaaacagcgtcagtaacaacgttgttgtttggctcgattccgaagattgagtcgttcaactcgatctcaccggcgtttgagccgtcttgcttaaacaaagcaaccttagtcatgttagtttcctcccttcgtccttattacttagccttaacagagtacttaacagtaacaagtgacttgttggcaccaggaacattacccttaaccaagatcacgttgttttctacgtcaacgcgaactacttgcaagttttgtacagtgcgcttgtggttacccatgcgtccaggcaacttcttacccttgaagacgcggttgatgatggcacccaatgaaccaggacgacggtggtaacgagaaccgtgcgccataggaccacgtgattgtccatccttcttgatgttaccttggtaaccatgaccctttgtgattccagttacgtcaacagcttcgccagcagcgaagatgtcaaccttaacttcatccccaacattgaattctccctcagcgtcgcggatttcacgaatgtagcgcttaggggccgtgtttgccttggcaacgtgaccttgctcaggcttgttgctcaaaacggcacgcttgtcttggtaacccaattgaactgcgttgtaaccgtcgttttccaaagtcttaacttggagaactacgtttggcgtagcttcaattactgttacggggataagctcaccgttctcagtgaatacctgagtcatgccgaccttgcggcctaagatacccttagtagtcatgactatctcctttgaatagtaaatctaaatttttgatcagttaaatgcttaatcaggcaagttgttgttgctgttgttgcgttgtaaaaattacaacttgatttcgatgtcaacaccgcttggcaattcaagctttgacaaagcatcaaccgtcttagcagttgggttcacgatatcgatcaaacgcttgtgagtgcgcatttcgaattgctcacgtgaatccttgtgcttgtgtggtgaacgcaaaaccgtgtacaacgtacgctcagtaggcaatggaataggacctgaaatttcagcacctgtacgctttgccgtctcaacgatcttttctgctgaagcatccaagatcttgtgctcgtacgccttcaaacggatacgaatcttcttacttgccatgatataaattctcccttcgtccatattggaatatgaaactaactccgtggaaactaccgacgcaccccaaagagctccatggcaatgggccccgtggcaatgctgccgggtgtgtcgcaacctcccacatcatcgcttgtcgatggcacgctaatacgcgggtgcacaatgcaccctgtatttaacgtactagaatataatacagcaggctaaccccgttggcaagccttttgaacaactttcttgaattaatttcttaaccccgttcatgtcgtgttcatattttattccgaaaactataataactgatttacttactaatttccaccgttttggttctatttaaaaaaattcgtaagtccctctcagaattgcatgtgtttattcagggttattcctatataatagtagatagcttattcataccatgttatgaacacatacatattatagtagataaacaattaaggagttccttagtaatgacgcaatcactcacacaacttcatccgatttggcaagactttcctgctatccaaaaggaactccaagcagtcttgaatcgcattgaagctaatatggatgctaatgatccagaagtcgaagcggctcttttcgatatgtttaacgccggcggtaagttactccgccctgcgttcacattgttgattggtcgtttctaccctgccgaacgcgagccactattgaatctcgccgctacggttgaaatgctccacacagcttctttagttcacgacgacattatcgatgactcaccaactcgtcgtcacgctgaatcaattcaatcccgcttcggtaaggacgttgctgcatatgctggtgactacctattcgctgtaacgttccgtaccttagcagacaacacaaatgatatcgaaacggttcgcatggcaacccgctacctagaacgcattctatctggtgaattgacacaacgtacgaatcactaccgtactgatatgacgatcgcggattatgaagaacaaatttctggtaagacagctgccctattcgtactagcagctaagctaggtatcgcagctagtgatgcgccagataactttgctgaacttgccagcgacttcgcctacaatgtcggtatggcattccaaattttggatgacatgcttgattatcaatcagatagcacgacactgggcaagccaacattgaacgacgtgcgtgaaggtgtttactctgcaccattgattattgcgatgcaaaacaatgaacgtattcaagccttactcgcaaagcaaactgaaatcacgactgctgaggctgaagaattagcccaacttgttcgtgactccggtgcgcttgatgaagccggtgatatggcgatgcgttatacagaagctgcattaaactatctagacgatatgccagaacatgaatcaaaagacatcttgttcagcatcagtcgttcactactctcacgtaacgactaatatatagtagaaaaggtaccgacaattcattttgtcggtaccttttttgttaatcttctagataatcaaattccaaaccagggttggcatttaagtccaaaccaccacgcttgccatgacgataagcaatatcaccagcagcaccaatcatcgccgcattatcaccggccaacttaattggcactgggataaatgtcgtgtcagggaattcagccatcattgccgttagtccatcacgcaaaccacggttagctgcaacaccaccagcgacgataaatgacttcactggataattctccaaggcacggcgagtcttggttaccaagacatcaacaactgcctcttggaacgacgccgcaaggttaacatgatcaaccgtctcgccacgttggtcagcattgtgcatcaagttaatcaccgcactcttcaaaccagagaatgaaaagtcataacggtcatcgttaatcaaggcacgtggcaaatcataagttggttcaccttcatgcgccatttcatcaatcgtctttccagaggggtattgcaaccccatcgtacgaccgaccttgtcataactctcaccggcagcatcatcacgtgtatccccaattacgaggtaatcatattcctcacgcatcaaaaccaattccgtgtgaccaccagaaaccatcaaggctaatgccggataggcaattggttgcacgaagttcgccgcactgatgtgaccagccaagtgaataaccggtaccaatggcaaattgtgcgcccaagcaatcgttttcgccgccgtaacaccaatcaacagcgccccgaccaaaccaggcccttgcgtcactgcgattgccgtcaagtcatcatacgtcaattgcgcatcttccaaagcagcatcagctaacaccgttacttgttcaatgtggtgacggctagccacttccggtacgataccaccaaatcgttggtgactcttgatttgtgtcgctgtctccaagctcacaatttcggtaccatttttgacaatcgccacacttgtttcatcggcacttgattcaaaggccatgatataacgtgtttcactcatgctattctccttctccacgcaacggcaatgtgacatccatcaagtaggcgtcttccaccgggtcacgatagtaatcttctcgtatgttatagatgataaatcccaagcgttcatataaacgaattgctcgcttgtttcgatgacgcacttccaatagtacccgcgtaccatcctcaaagcgcccaaaccattcacgaagtagtcgttcgccaaggtgttgtccctggaaaccaggcataaccgccacattggtgatttcaagttcatcacctaaatgtgtcccaccaacaaagccaaccgtctcaccgtctgcttcgatcagcaagtattttgtaaacttacctttcaagtcattttgaaaaactttcttcgaccaaggtgatcctttataagcagccttagcaatcgcgtacagctcttcggcgtccgtactatccctgaatgtaaaatccatcactctttctcccgagaatctgcgccatatcaaacgcgtcttccccgttatctccataataattcgttttacgacgaaccgtttgaaaacctagtcgttcgtacaggcgttgtgcattcacattcgatacccgcacttccaatgaaacgcggtggaattgaatttgcttggcaaccgtcatcatatacatgagcaaaaacgttcctaagccacgtccttgccagtgcggtgtcaccgtcacattggtgatatgcacttcatgaataccaggtcggaatgctgcgccaatataggcaaccatcgttcccgtctctggttcacgaacaacaacgtacaagcgctcgcgtgaacggtgtaactcattatggaagatatcttccgaccaaggttcctcaccgtcatacgctgcccgttctagaacaaccatttcttcaacgtctgtgtattgcgctggcattaagtggaactcaaagccgttaaccgcaatcacctgacgaaattctcgtaaactttgtggcaatgggtgcataaaccaatgaacccaattcttaaaccttttccacataaacaccatcacctgcatccgggtgagccttggcccaatcagcctcagcttgcgacaaacgataatagtttggcacaaattggtgaatatctgtcatgtctgttagtacttgtgcatccgtaaccagcggcaacacatttgcggcatgtggcaaattatcagatgcaaattgtgcatctggcaaagcctgtcgcaactcttcctcaaaccgagcccattcaccaacaaaaaccacttgttgattctcctctgccacctgactaatcaaatctggaacattcgtgtgtcgatcaggcgccgtggcaacatacttgccatcgcgcaactcatattgaccagcatataagttcgcattacgtgcatccatcactggcacaatcgtcacgccaggtgtcgttacgttcgttgccagcaagcccaagcttgagataccgaccaattcgatacctagcgtaaaggccaacgtcttggcggttgtaaccgcaatacgcaatcctgtataagaaccaggtccttggctaaccacaacccggtcaagatcagccggcgcccaccctgctgacttcactagttcatcgataaacggtagcaattgcaccgaatgattcttagcgacgtttgtttcacgttgtccgattagcttgtcgtcttcaaacaaggctaccgacaatggttgattagacgtatcaaacgcaataaccttcatgccacactacttcctttactctttagtcatatggtatttatcatacaactttttaccggacttttcattaacataaaattcaagcggtactccaactatgtgattttcatccacaaataaaaaagacagtcaccagtaaaaactggtaactgtctatacaacatagctactcaaacaccatcatttctgattattgaatgctttgcttcaagttctctacagattcattcagtgaatctcgtagtgacttcaaagaatcaactaaagtgcttcgtccaaccaacttgttgttcttcaatgcgccataaagcttttcttgcttgtcgaactcagcgtcatacttttccttcgtagcctggaatgtagcatcatcatacatcgcagttccctgcaatgcactttcatattgtgcatagtaataattgataatggcttcatacatattcaagtaatcaccataagtcttaattgattcaatctttgcatcggatacatcctgaacatcaaacgccgtatccccttctgcagttacctcacttgatgattcctgacttgaactagcctctgatgaaccgctttctgatgaagaaacagatgtcgactcagactgttttacgcttgatgatgatgtctctgacttgctactttccccatcggatccagcaccaccaccaattccggctaccacaataacaactagcacccaaaaccaccactttttgtaaaatggcttcttattcttaggggatttcccacctttattaccattgtcaggtgttggttggttttgattattaacttttacaactggcatttcatttctcctttaaagcaatcagttagatgcccattacttctgattttttcttatcaaattcttcttgtgtaagaatccctgcgtctagcaattccttaagctttttaagcgtttcaatttgttcgtccatagacaaagattgcgacttagcttcagcattgtttccaaggccacccgcataattcatgccaaaaatcatcccagcaccatcaccaaggccattttcctgaacgccttgtgcaattttctgttgcgccgcaatgttcgctgcttgttgcgatacatcttcaaacgccttcacgttcatcttgttctgagaatattgatttactaaggccttagagtcttgtgaaaattcaatgttttcgattcctactcggactaccttaaaaccaaaacgctctggccaagtccctgcatttgtcgtgtcgtttgcgaccacttcggaaactttttgagcttgcccaggtaactgagaaatacgatactcagctgataacgaattcacagccacgataaacgattgaataaactcagaaacgacttgtccctttgctttttcgtcgtcaaatgaataataactgacattagctagtacaaaatttcgaataaatatttctggattagtcacttgaaccgaaaaagcaccaaaagctagcacttctaagtctgtaccataaaacgcatcgttatatactaatggccctcttgtaccaaacttgatatctctgatttcacgcaggttcacaaaagcaatatgcttttcttcaccgggttggcctccaaaagtaaatcgatctttagcctgattaagaactgcaccaacgctagctccattcaacagactatcttctccgttttggtaagcaaactcccccggttcattaataatctcttcaataccagcctggctaaaaataaaagctgcagtattctctggaacacgaattaaagatccgttagtaatcacgccagttgatgcttgggtgtttgaaccacgcccaccgttactcttctgcaacactcctggagctactactgtatgctcatcaaaatgtcccgctgtaaatatatcacgccattgatctgacaatgctcctccgacagcgcctttaacagcatcaaacaaccccatattattttcctcctctacatttaaatgacttgctcagtcccacagtacgcacatcgaacagtgctacctttaattccagatatcggggcaacacatgatttacactttgctgaaacagattctcgaggagcctctgtttgccgagcttctaactttttctttttatcacgtttcgtaatgacatcagccaacgccccaattgcagaatttgccgcatctattaccaatcctgcatcaggattgatagttgaaatagcgtccaacaccttaccgttagaccctcggcgctttttacttgatgagaattcggccatgtttcctgaagcaaccgcacgaatattgttcgcccattcctcagcaactctattcttttcaaactcaagcgtgatttggtcttgccaaaagaatacctgaacagtcaaattatccttcagcaacacctgaggaacaccatctaccttcttaacctggctcaatgggtatttattaaccactgtcttggttttaaaaaaaccaattgtttcaatagaaataatatttagattagtcaaatacagctcatcaccctctgacattagaactgattcgctagcttgtagatttaaatccgccatccccaaactccttcataacgtttagtttctcttatgtacaagatacttcaaacattagaaaatatattgaagatttgtagttagttggtgacatccatctatcgaaaaattgccgttaaacccctaaccccaatgcaaacaaaaaagacagctaccagaaacctgataactgtcttgataatcaaatattagcggtcttcataaccgtttgggtgcttttggtgccaagtccaagccgtcttgatgatttccttaacatcatcgtacttaggagcccatcccaaaatctcacgtgccttgtctgatgacgcaaccaatgagtcaggatcaccggcacgacgtggaccaacttcggcagggatttcctgaccagttgcttcacgcgcagcctcaaccatttgcttaactgagaagccgtttgctgaacccaagttaaattggtttgagtcgttacccttagccaagtagtccaaagccaacacgtgcgcgttagccaagtccattacgtgaacgtaatcgcggacgttgaatccatctggtgtgttgtagtcatcaccgtacatcatgatcttctcgcgttgacccaaggccgtttgcaagatgattggtaccaagtgcgtctcaactgggtggtcttcaccgattgaaccgtcagcctttgcaccggcaacgttaaagtaacgcaatgcaacccacttcaagccgtaagcttcatcagcccacttcatgatgtgctccatttgcaactttgactcaccgtatgggttgattgggttttgtggcgtcgtttccttgatagggttttcctcaggaataccgtacgttgcagccgttgatgagaagacaatttgcttaacatcaaactccaacataacttccaacaacgcaatcatacctgccgtgttgttgtcgaagtactttagtggatcagccattgattctggcacgattgatgaagccgcaaagtgaacgacttgctcaatgttttccttctcaaatacttcacgcaaagctgccttatcacgaatatcaacttcgtagaaaggtacacctgcaggcaccgcagcacggtgtcccgtcaacaagttgtcaacaacgacaacatcgcgaccgtctgacaacaatgtgtcaaccatgtgagaaccgatgtatccggctccacctagaaccaaaatggccatgtgttttctccttaaatgactttcttcactaattagtttactttagttttctgacttcgtccaatcaatatgcgcttcggcagacaatgtatcaccagaccaaatgcggtgaatcgtcttatcttccataatttgcgcttcagaacgcacagtatcaccaagcaaaatttcgtgttcgtacttgatgttcaaatgtgttggttcatgagcttcaaggaatgctggtcccagcacatcttgcatccaatcaaagtactttgaattattaacgtggcggtttgaatcaatgtccaaatagcgaacggcatattgttgatcgacgtcaactggaatatcaccaatcatgtggtcaggctctggttgacgtggaatcttcttcacacgttcaggtgcgtaggcatccaccatctcttgtggaatacgcgccatcttacgcttctccatatcaatcattgcgtacaatgcatcgatgctgaccaattcattacctgcttcatcgacaatgcggtacaaacgcttcgcaaagaatgggttaaactccttagccaatgtttccaaggccaccttttcaccaatcttaggacggcgcttaatatcaacgacgtgctgcaaaataatccaaccaacaccgtttgcgtgtgcataatccggtccgacccccaggtcgacactttgttgcgttgaactcaacacagcaagattaaaaatcatgggcaggctcaacttgcctgtcacgtcagcttcgtagtacaacacctcgtgctgcatactgtaaacttcagccattaattctctccttgatattccaaatacaacgcttggcggtccaagtcacgcgctttggcgacttgcttaaccgcagccgttgcttttagccctgatgcaacaagggcttgtactgcctccacagcagtcatttcagcaagtgggtcgtcatccccatcagtagttgggttatcatttcccgccaccatcatcacaaactcaccacggacttcgttttcacttgcccaatcaaccaattcttgcgctgacccacgcaagaactcttcataacgcttcgtcaactcacgagccaacacaacttggcgatcaggtccaaacgccttcaccaagttttgcaacgtcttagccaaacggtgtggtgcttcgtagaaaatcattgtttccgtgtgtgaattcaaaccttgcagttctgccaattgctcctttggcttacgcgccaagaaaccgtaaaacataaagggttgtggtgccaagccagacgcaatcaacgccgtaataccagcgcttgcccctggaagtggcacaactggaatattttgcgcaatcgccgccttaaccaactcatgaccagggtcagaaattgatggcatccccgcatctgacacttgggccacatcttcaccagcagctaagcgtgcaaccaactcaggaatgcgactctctttattgtgttcatggaatgatacttgcttcgtttgaatatcaaactggttgagcaattgttgcgtgtgacgagtgtcctccgccgcaatcacggccacagccttcaatgtatcaattgaacgaaccgtcatatcacccaaattaccaattggcgttgggacaagataaagcgttcccgttgtatgtgttgcaaaacttttctgttgattcatcataaacctgctaacttaaactgactttcaaggacggttgattcgaccgtcgtttgaaaactaatatttttctgtaaacgttgtggtgccgccaatacgatatccaacacttccaacagtttggccgttgtataacgttgtgacaaacgctgccattcactagcccctgggaaacgaacactcgcatcgccagtacgaccaagcaagatatcacgccatgcctgggccagcatcgccaacagcactcgtgcacgggctggctcaccagctaacggcaccaaagctgtttgcacgtgggtaaaggtggtatcgtcacccttcagtgtaccagtcacgatatcactgaccgccttctcggctgagttaaaccaatcatcaactagccactcagcggcgctatccacgctatccgtcaacgtacgcgccaattcggcttgtgccggcgtaaagccaactgcctccaatgacgtgcgcatttgttcaggccccaaagccgggaaatcaatcacctgcgtacgtgacacaaccgttggcaaaatttgtgcccggttttcagcaatcaaaatggccgtttgttggccaaccggttcctcgataaacttcaacagaccgttggcggcactgctagtcatcgtatccgcaccagaaacgataaacaccttttgattaccttcgacggccgtctttgtaaattcatcacgcaagtaacgcacctggtcgaccttgatgctgttaccatctggtgccaattgaatcacgtctgggtgttcatgtgacgcaatacgttggcattgatcacacatcccgtccggttgtccgtcagccgtaacattacgacacatcaaacgcatcgccaaccaatcagccaccaagtcttgaccacgaccacgtggcccagtaaacaaaaaggcgtgggcaagttgctcacttgccaccgcctgtttgaattgcgcgattaactgcggttgttgtgcatttgcctgtgcaattaattctttcgcgtccatacttgccccttagaagcggtggaattgttcaatatcttgaacaaagaccgttgcgccaccaacttgcacttccattggtgttgaagccgttgattccattgagacatcaaggctaaccgctggtgtcatgaattgcttacgggtgtgtgatgtttccttgatcaactcaagcacttcatcgacacgctcgtcttcaataccaatcataaacgttgtgtttcctgaacgaaggaacccacctgacgtcgccaaacgagtggcacgcacattcgccttcacaaattcagttcccaacttgtttgcatctttatcttgaacgattgcgattaccatcttcataaagctgaacctcctagtccttcatccccaaaattggtgccagcgctgcccatgtatcagcaatcacagcatccaattcttgttctgcattaatcatcaaaaagcggtctgggtattgcttagccaattcatggtaagcatctgacacacgttggtggaatgacaacgcttcgacgtcgagacgatttacttcatcttgacgcgttgtttgaatacgttgcaaaccaacctctggtcgaatatcaaggtagaccgtcgcttgaggcataaacccttcgatggcaaaatcattgattgccgccaccgcatcagttcctaattcacggcccccaccttgataagcaattgagctatcaacgtagcgatcggtaatcacaaccttgtcagctgctaaagctggcaaaatcgtttgtaccaagtgttgtcgacgtgaggctgcgtaaagcaacgcttccgttcgttgatccatctctgtattggctggatcaagtactaggtcacgaatcgcttccgcaatcttgttgtcggttccgcccggctcacgggttagcaataagcggtcccctagttctggttgcaaccgtgcgacaatcgcacgcaatactgatgtctttccagctccatctgggccttcaaacgaaataaatgtccctggcattctcgccaccactttccactttatctaataatacttttattatagcaaaaagccggcccaggcataacacctgaaccgactttggctaaacgttccagtcgatgttctctggctttacgaaagccaattcgaacaaatagttagaaatgcgcgtttgtgaccacttcttaccgtggtctggcaacaaacgtgaattctcaatgagacgttccttcacccacttagcattggcctctgtccattgcgtgttcttcgcaatcaaagcaccaaattgggcgtttgtataagtcttatcactcattataaacacctcctattctgagctttagtttttaaacctctgggtggacaaaagctgttgaccagtgacccttcatatcacgttgacgcgccacgcgaagtaagaagaaatacttctgacgggccttggctgtttcagccttaatcaaacgtgggtcaatgtcactttcaaacaaagctacttctgacatttttgctttttcaaagtcgaactttgcttgatcaatcgccttgttcagacgttcatcgtaagctgctgtatcaacttttggtcgcttaaacatgttaaacatcagagctttgtccttccttcaaccgctttaatcaacgtaatttcatcagcatagtcaatatcactaccaactgacaatccagtagccaaacgtgaaaccgttagaccggctggcttcaatagtcgtgataggtacatagctgttgcttcaccctctgcgttagcgttcgttgcaacgataacttcttggatggcatcatccttttgcaaacgcgttaccaatgactcaatgttgatgtcatcgggacccttaccagatagtggtgacaacacaccgtgaagcacgtggtacaagccacggtactcgccagtgttttcaattgccatcaaatccttcacttcttcaacaaccaaaacttggctttggtcacgtgttgggtcagagcaaattgcacaaggatccgtctccgtcagatttccacagattgaacaaaagcgcaaatcacgcttagcagaaatcaatgattgggcaaaccccgtcacatcttcttcttgcatgtcaattgtgtggaaagctaggcgtgtcgctgtcttaattccgataccgggcaacttcgtgtaactatcaataagtttagcaatcggttctggatattgcacgttacagaccttctttctcccaataaaccaaccggcttaaaacataccctttggtgcgtattgtcccaaacgcttttgttggtcagcttcgatttgttgcaatgcatcattaactgcaaccaaaatcatatctgccataccgtcgacgtcatcagcgtcaacgatttcaggcttgatttgcaagtccttcaactcacggtttccgttaaacgttgccaaaacaacgtctgaaggcgcgtgaccagtgtagtcagttgctgcaattgcttcttgctcgttttgcatttgctcttgcatcttctttacttgcttcatcattgattgcatgttttgtccgccaaacataatatcaccctcgttttctagtttttgttattaatcatcaatttcttctacgatatcagcgccaaacaaacgttcagcttccgctacaactggtgctggaccagctgcttcggcttgatcatccattgccgttagacttgctaagtcgtcatcaacagcagctgccacttgttgcggcacttgttgttgaacggatggcgttgcagccgttccttgacgttgggccacaaacgcagcacgcatctttggccagtcatcagtcgtgacaaagaccaattggcgctcgttttgagcttgcgtcaacagacggatttgcgtcaccatcgtgtgcaacaattcggcgttgcgcatggcgttggctttaatcacttcaaagtcaaaggccacgaccaagccatctggcgaagcagcaattggcttcgcaacgttcaacattgcttgttgtggcactggcaacatgttaaccatgtcagcccataccgtttgcacacggtctaggtcgccacgggttgctgcactaagcacgccgaacacagctgattgatcatccgcaacacgtggtgcgacacgcgttggtgccgccgtggctggttgttcagccggtgctgccgatgccactggttcaggttgtggcgctggttgcgttggtgtctcaacaactggtgctactgaagcaaccggagctggcgctggctttggtgcagttggtgtcggatcagcaaccacttgtggcgctgacacacgttcaaccgttaccggtgccgtcgtggccatcggttggctcaacttaaccgtcaacacttccaagtaaatgcttgggcggttcgtgaaacgcaattgttgttgcgtgtcattcaagatatcaatcatgcgataccaaacgttagcttgcgtgttcgcggccaagtccgtgaatgtctcatcaggcacaatgctgatcaactcaggcgcttcagtgtgaagtagcaagtcacgggcataactaatcaagtcttccacaaagcggttagcgtccttacctgctgataatacctcagataacttagccaaagcttgctttgtgtcttgcttaaccaccgcttgtacatattcgcccagcaatgtttgcgtcactgaaccagttacaagcaaggcgttttccaacgtcacgtgaccatccccaaatgacaacgcttggtccaagatactcaacgcatcacgcattccaccatcagcggcgttcgcaatcacgcgaatcgcagcttcatcatacgtgtcgccacgttgatccaagatgtacgtcatacggtcgtatgcggctttggcatcaatgcgcttgaagtcgaaacgttgtgtacgtgaaataatggttgccggaatcttttggggttccgtcgtggccaaaataaagataacgtttgctggtggctcttctaatgtcttcaacaaggcgttaaaggcaccggttgaaagcatgtggacctcatcgatgatgtagactttgtactttgcttgcgttggggcgtagttaacgtcctcacgaatctcacggatttcatcaacaccgttgtttgaagccgcgtccaattcgataatgtcaccaagcgtaccgttatcggctgcttgacacatcgcacatacaccatcaggctccccattaatgggatttaaacagttaatggctttggcaaagattttcgcagcggatgtcttacccgttccacgcggtccgttgaacaaataggcgtgggttgtttgccccgtcataattgcgtttttcaacgtcttggtcacaacttcttgcccaatcatgtcgctaaatttttgcggacgccatgtccggtacaacgcttgatacgccattgtgtgtgacccctttcgatgctgtccattgtgacagcaaagtatgaattttacctactcttatattaccagaaaacagtaaaaaaaacgccaaccgattagttcatcggttagcgattaaagttcataagaagtgaagcacaatgcacggtctccttagtgctgctgccttccgaccctgacacggttcgaagtgcacacttgccccacaaacaatattatagcaggtggattacttttctgcaatctcattcgacaattcttgtgctgccaattcggctgcgcgacgagctttcttttcagccttcttctgcttgcgaatttcgcggaagaagttacgcaataagtcgccactttcttgctcacgaacaccttggtgcacgttcacctggtggttcaaacgctcatcctctaagatgtggtacaaagagtgcaccgccccagcctttggatcctcagcaccataatacacatcactaatacgtgactgttgaataatccctgcgcacataatgcatggttccaatgtcacaaacaattgggcatctggcaaacgccatgacttcaccaaacggttagcctcggtaatggcttgtagttcagcgtgttggctggcatcttccaaccgctcacgtaggttaaaaccacgtccgatgatttgaccattttgcacgacgaccgctccaatcggtacttcacccaaggcgcccgctttcttggcttccttgatggcctcacccatgaagtagtcaacttgttcaggcgttagcgtcgtcatggtagacactctccaaaatatagtaacccttgttcttggcaatcgttgcagcgttaccaaacgtttcagccatcaacgccttggcagatggcgcaccttgcttcttttgcaaaacaaccgtcagcgtaccgccatcaaccaagtaatccttcgccccagcaatcatatctgacacaatatccttaccggcacgtaccggtggattcgtcaaaatcgccgcaaacttaccgtcaacgccagagtaacggtctgacaataccacgttaatgcggtcgccaaccccgttcttttgggcgttacgcttgaccaattcagctgcacgctcgttgatttcagccgccacgaattcgcggtcaggcatcaccgttgccaatgcaattgaaactggcccgtagccggcacccaaatccaaaatctttccagcgggaatatcttgattaaacgcatccaacatcgtgcgcgttccaaaatctacggtagacttagagaagacaccggcgtccgttgtgaacgtcaaggtgtggtcaaaaagcgggaacgtccaagtatgctcgtcgtgagcaacacttgggttcgccgtgtaataatgttcagccatgtgaacctctttctattctcaatatcagaatcctgataatcttcaaagtttagtatataaaccattgtatgatatagagactaattattaaagcaaagtacttggggaggtatttgattatgacgaaacagacaattggcgtcttcatgggcgcccaattcggtcacttagaagcattccacgaagccgcggctgcgatgggtaaaggaattgcagatcacgactgggcacttgtttatggtggctcaaagggcggtttgatgggtgaagtcgcagaacacgctatcaacgccggcgctcatgtcactggcattcgcccaacatctttgttaccagaagaagccagcgataacatgaagatggagcatatcgacgtccccgacatggacacccgtaagcgcatgatgtttgaccgcgcggatgcctttgtcttcctacctggtggtatgggaacgctggaagagcttggccaagtcatgtcatggacaaagcttggttactacgaaaagccaatcgtactggtgaatgtcgatggctattgggatgacatggtggcttggttcgaaacagccatcgaagcagaattcgtcacccgcgaaggtctttcacgcttggccttgattccaacggtagacgaaacattcaaataccttgaaggtgaatttggtgaataacagaaaaatggtgatgatgtcaaaaatcgggcatcatcaccattttttatgcaataatatcggtcttttcaaccatccaagcagctgcagccatgagaacaatgagtaccaacaagacaatcaattgaattgtccagctgtgccacaatccaaaaccgtaaccaaacaaagttggcccaaacgcagccaataggtagccaccggattgtgccatacctgatagttcagccgttcgcgttggtgtggttgtcttaactgagaacatcgttaacaagtaagggaacaatgccccacctgagaatcccatcaataagttaacaatcaaccaaaacaaaaaactgtgaccattgaataagatcatccccaccccaacaaatgcaaaggcagagaagcccaccataatccagcgacgttgtttgttattccaacgtgtaaaggcagttggtagtacaaacgtcaatggcaatgtgattagcgtaaagatacctgataggtaaccagctgcttcagccgataacccagcttgttgcgccatcgttggcagccaggccatcgccgtgtagtaatacaatgactgtaacccaccgtatgccaacaaataccacgcccgcttgttacgccaaattgacgactgtgcgccgtcagctggtcggggttctagcacgtgattttgctttgtatttggtagccaaacaaccaaagcaagcacaatcaatactgacaaaatcaaaattaacgtttgccaattagttgctctgacaattggcacggctaaggatgatgccaggatagtcgcaatcgtcatcgctagtgaatatgttgacgtataacgaccaatttgcgttggaaaatttgcaacgacggcactggggagcaacacattcaacgttgcaataccgacgccaatcaatactgttcctaaaaacaaaaatggcatcgaaataatgcgtaacaatgacccgactgccattaacaatacgaaaatagcgaacgacttttcaattccccacttttggccaaatttcggtgccaagggggaaacaatggcaaaactcaaaagtggaatggttgtcaaaatccccaatgaactaactgacacccccaaccctttcgcaacttcactaataactggcggaattgatgtaaacggaatacgtaatatcattcccatcatcacaatgccaggcaccaaaaaaggtgactgattcttcttttgcataatgaactctcctcaatagatgcttcgctatctctctaaaacagcttatccattgtaagttaataaaaagcgctgcacaacaacgtgcaacgcttcactaatgctttttacttaaaatactttgccaagaaatcagcaaccttttgctcatacttagctgggttggttgcatatgattgcacgtgtgaggcacctgggaccaagtacttttcctttggtccgtttgaggcgtcatacacttggttcaagaacttcgttggcacaaacgtgtcatccccaccgtgaataaacatcattgggcgcgtgttcttttgcaacaacttcaacgcgtcagcttcagcgtagtcataaccagccaaaacctttgagtacgttgaaaccactggcaagataatcttagccaaccacattggcaaaccatacatatcacccgcttggtattccaactcgtcataaactgacgtgtaaccagcatcttcaatgtacgccttaacttgcgctggtggattcattcctgacaacatcatcgtcgtggcaccacccattgaggcacccatcaccacgatttgactatcttgaccattcttggtaatgaccttactaatccattgcttgtagtccttggcatccaagtaaccgaaaccgatgtacttaccacctgacttacctgacgcacgatcatcgggcatcaacacgttgtagcccatgtcatggaacatttgtccataaggtgccattgccttgtgctctacaccgaatccgtgaatcacaacaaccgtcttgttggtcttcttttcagctggtacataattaccaaccaacttagtcccgtccttcgccgtcaaatgccacgtttgtgaatccaacgctaggaactcttgttgacgtgaatacaatggatccttcttcgtcaacaccccactaccgataaagtccttcttcgcacgcacctcggcgacgtggaaaaaatacccaccagcagcgccgagaataactgccaacacaaccacgattgaaactacccaagtgataatcttacgtggcgttgaccagcgcttcttttgcttagccatattcgctaacctcttactcttctataaatgtataagtgcaacctgtccattataaggaagaacactagaaaataaaaggtataccccgttaagcaaatgcctgactacttgatgtgcaacaatgagtcgatcaacttatcgcccattcgatccaagtactgaccttggcgttcccaaagcgacttgccgctcaacgacttctcactttcagccggcaatggttgattttgcgtcgtaatcgccgcaactgccccaacaatccaaacacccaagctgaacaccactagtaatctcactaacttctttcgcatgccacaagtcccccattcctttttgttgtctctcagtctagtcgccaattgtcaggttttagcaggttttcggtcacgattgtgtaaatgttttgttgccaaattcggaacatgcccatcattatttttctcaaaaccagtcgccactgtgctaaactattagaaaactatgagaaatacggagcaccaacatgagctattcattgaactgggatttggatcccatctaccctggtggtatcgaatcacctgagttcgctgccaagctaactttactcgatcaacaaattaagcaattcgcgtctgacgtgactgcttacgaccgtttcacagacacggacttcagcaagctcgtcgctttggtgaacgacgcgcaagtgattcgttcaggtttgggcacggtggcacttttcgtcaacgccctttactcagccgattacacgaaccctgtctaccgtccctaccaaacgaaggtctcacacttggaagttgcttaccaagcgccattagacgcctttgcgaagttgttgacgtcatttgatgatgagacattcgctaaggttagcacgttgcctggcatcgctgaagtcgccttccacttgaacgagttgcgcgatgacgctgctcgcttgttggatgaccgcgccgaagaattgctcaacaagttgcgtttggatggcttgcaagcctggtcagagcactacgacaccatctcatctggtctttcaatgacgtacacagatgaaaacggcgacgagcaagctttgtctgccggacaagcgttgaaccaattggacggttaccctgacaacaaggtgcgcgccaacatcatggccaactacgaaaagatgtggggtagcgccgaaaacttggccgccgacacgattaaccacttggctggtgctcgattgacggaacaagctgcccacggttacgaaaaccacttggatcaaccactagagttgaaccgtatgtcacgtgagacattggacgccatgtggcaaatggtcgatgacaacaagcacatgtttaaggcgtacttcgatcgcaagaaggaattgcttggtttgacggagctaggttggcaagaccaagtcgcccctatcacggatttgggtgactacaagccaagcacgttgtcatatgatgaggcggctgcgttcattattaagaacttcggcaagtactcacctaagatggccgcattcgcacaacacgcatttgagaatcaatggattgaagcggaagaccgccctggtaagacaccaggtgcttggatggaaagtgtacctgacattcacgagtcacgtatcatcacaacgtttacgggttctgtgaatgacgcagcaacgattgcccacgaaattggtcacgggttccactcttcagtcttgacggacttgccagtttggcgtgatggttatgccatgaacgttgccgagactgcttcaacgtttgctgaaatgttgattgcggatgccaacgtgcaagctgcccaatctgatgcggaaaaggttgtcttgttggatgcgaagatgacgaacccaatcgccatgttcttgaacatccacgcccgcttcatctttgaagacaacttctacacggagcgtaagcaaggcttcgtcccagctgcgcgtttgaacgaattgatggatgaggcacaaaaggtggccttcgatggtcttttggatcaccgtcacccacacttctggtcatcaaagttgcacttcttcattgatgacgtgccattctacaacttcccatacacgttcggttacttgttcagccaaggtatctatgcctgggctcacacgcaagataacttcgaagaagcctacatcgcgttgcttcgtgatacggccaacatgtcaacggaagaattggcccaaaagcaccttggtgttgatttgactaagccagacttctggcaatctggtgctgatttggttaagaaggacatcgatgaattcttggctttgtcagagcaatttgtaaagtaatgccaaaaacgcctgcattcaattcagaatgcaggcgttttactatgcttattacttcttatccaaaatcatctttgacgttaggatggcaagtgatactgccaagcccattggcatcaaagcggtgtagtccaagtgactcacttcgaacatcatgaacaaggccatcaatggcgcttgttgtgaggctgctagcaatgccgtggcaccgataacggcggcttgggcaactgatgcacctggcaccatcatgatgtaaccgaagccaaggatggcaccgaatgatccaccaataccgattgatggtgccaacgtaccaccgtaggcaccggccttcaatgtgaagaccgtaatggcagccttaagcaacatcccaatcaacaagacaccaatcaccttcgtgctcgtgctgttaatggcgaactcagccaaaccacgtccatttcccataatttgtgggaagtagatggcgaccacaccggttacggctgcagccaatggcaattgccacaagacttgcacttgcttagccttggccttaccgccagcccattggaaggccttgcggaagtatgcacccgcaacacccatcaatggtccaacgacaatcacgaatggaatcatccccaacgtgaagtgcttatcaggtacaaagtagtatgggtggaacccgtggactgacatacccacccacatggcaatcgttgacatcgtcaaactgaccgcaactgaacgctttgacacgttcttgtgcaagatttcaacggcgaacaacataccagtgattggcgcgatataaataccggcgaaaccagcacccgcagctgctgcaatcaacaagcgacggtcgtcagccgttagtgaatccatgtgccaacggcggagtagcttctcccaacgttgggcaagcaaagcaccaagttcacgaggtgccaattcacgtccaactgatccaccagttgctacgtagaagacttgcgtcacggcgtggacaactgaaggccagaatggcatctcatctccatccatggccttgttgatgccaaccgttggcttcatcttcgtttgcacaatgaaccagacaatcgccgcaataattccaccaatcaatactgataaaaagcgttgtccgccagcaatgtgcgttgaaactggcatcagcgtgttttcttcaaatcccaagaagaagtgctcgacgagttccaagaacaagctgagcaacactgaacttaaccctacaacaatccccaaaataacggtagatagcgccaagacccccatcttgtggcgctcgctgtaagttttctcttccaaaacagtaacctcatctcaaataatcgtttacaagaagttattataacacctaaaaagcccagtcgaaaaactgggctaatggttacttcactaaatagacacgctcatcaatcaagtcgaatgattggtggtgcgcgttcaatgcgggtacttcttctaactcggcttcgtgccagaagacatccgagtccgttgccccgcccttttcaccaatcacgatgaaatcaaaatcaaagcggtattggttgtcgcggatgtattgcaacacctgccagtccgcgtcggttgtgtctggcgcccaactcataataaccgttgagacattctcaccgtacatatccaacgctgcgatggcgtccatgttctccacatccgtcactggcttggccgacgttggatctggttgcgtacgccaatcttcattgtccgtcgcgataatcttttgcgccggcgcaattgccttcaagccggctgagatatacccatgaccagccatcaactccagcaccggttggccgtcggtgtagacagacaagtcacgcacaaagtcacttgagacaaagccgtacatgctgaagtattcgattaacgcatcacgtaaatggcgaagcaagaagtcgatatcttctagcggttccgttaactcaagccagagcgcattcccagcatccgcgttatctgggtattgcgccaagacataattttgcagttctggaatgactgactctggtacttccatcgttggcaatacagctggcaaataacccgcattcaattgttcaagcgtatcaatcgcttgttgcatgaggttggccatcgtggggatgttttggtaacggtctagatgtggcaacagctcaccaagatagtccatctcagtgagctgttggccagacccaaaccgaattgcttggtttgttgtcatgataatatcctttagttagaacaggctttcttggtggttgctacgcacatcatcctccggcgtgtatgataccgggttcaagtatgagttaacatactggaaaatgtcgaaacgttgctggtcagttagtggcttaccgttaaagtcgatttccttacctgacaagaacagcaatgacaagtcagtcttttctgacatggcacggccgaccaagaaatccattgaaacattgaaaaaatccgctagctttcgaacttcaatgtacgaaggcgaacggtcaccacgctcccagtttccaatttgcgcagctgtatttggtttttgccctggttcaaggtgcttattcatctcttcagccaaggtttccaatgtgatgttgcggcctttgcgcaactcacgcagacgatctggaaacatgtgcgtcgttctccgttttcataaagtaaattgggcacgctaaaagccctaatatatttctattctaacgaacattaaccgatttttccacacccaaattgtggaaaaccacttattttatccacacgctgtgaattacggcttaacagtcaacacaaccacgttgactgtcacagctggcaatggcgtagcttccgctgccgcttgggcttctggacgtgcgccccagtgcaatggcgtcatgtgtaacagatcaacatacaagtcggctggaatttgccattggtatgaaatctcggtttgcgtggcgtttggatagttctccatgaagcgatcaaccactttttggttactgtacgtgtgatttggtgaatccacagggtacaacatttcacgcaattcgtgaagataacctgatgatgggaccaccttcaccaacgttccttcgggcgctaagacacgcttgaattcttcataagcacttggtgagaagaactccacgatactatcaaagctattgtcgttaaatggtaggttcgctaagtcggcgaccgcaaagaacgcatccgtgtccaattgcgttgccaagttaacccctgccttagaaatatcgaaaccaatgccggtatcgatgttgccacgcttggctagcaaacgggcgaatggcgtcccttcaccagttcccacatccatgatgcgttgtgggtcggctggcaattgggccgcaactgcgtccacaatgccatcaaacaagccggccgtcaaaacacgacgacgggccgccaacatagcatcatcatactccgtattaacagcgtggttcaagaaataaagggaacccttcttgttaatgtccaagcggtggttatgcgcacataccaaggtattaccttcaacgtggtcatagggctcgccatctacggtacaacggaacatgtccaagtgttcgctgacgaacttaatccctttttcaatcttcttcatgtgattccttcctcattgctgcccagagcatatcatatagctgttcaaactctgcctcatgttcaaccttgtctgacttctgccgtgcaaacgtgacaatcgacccaaaggccatcgtcatgaatacttggactggcatgtcacgcagttcacctgtcgcaacccccgctgacaacatctcagcaaccacattttgttgctggtcagctggatcagccgccacacgattcaacaccggactgtctggcaactgcttaatttgcgaaactgtcgtcaatgtatctggcctttcaaccgcgatgcgatatagtgtccgcaaccagacacgcaccttcccagccagagtcggctcagccgttattgatgtgaccaacatgtcacgcataactgcttgctcatgttcaaagacttgcgttagcatatcagccttattattaaagtaaatatagatgttggattgcgagataccaacggccttggcgaccttcgttgttgataaactagccgccccttcagtcacgataatctgtatcgctgcctgaataattgtctcatacttcgattcatcttttttcttcatggtactaatataaccggtttattctgaaacgacaacgttgacaaaagataagtttattttttatactaagtccaccaattagagatagagttatcttttaagaaatagaggctattaaacatgaagattgcaatgctcggatcacttggtaacgttaaccgcgttgctgtacctgaattacttaacgctggccacgaagttaccctactaacgtcttcagcagatcgtgtcgctgaaatcgaggcgctcggcgcacacgcggtcgttggttcaatgaccaacttggatgacctagttgccacattgactggtgccgacgtggcgtacctcatgttgactggtcatgccacaggcagcctagtcgctcacggggaaatggtcggtaacttgttcaagcaagctatcgagacaactggtatcaagcgcgtcgttaacctcagcagcgttggtgccgatcaaggtcccgaaatcggcgctctttacgtctataacatcattgaaggtttgttggctagtttgccaatcgatattacgtttgttcgtccagtcgccttttacggcaacctaatgggtagtattcaaacgattaaagcacaacatgccatcattaacaatttccctgcttctcatcgtaatgcgtatgtttggcctgccgatatcgctaagacggttgtcgatgctatcttgcacccggttgccggtcaaacggttcgctacgtagtttctgacttattcaccggtgacgaattggttgctgcgctacaagaaacgttggccatgcctgatttgaagtgggtcgagatttcagatgagcaagccttagcaaacatgacagctaaggggatgccggaagcagttgcgactgaattcgttaagttggggggcttctcaacgtaacgaatctgcatacactgacttaacagcccacatgccagcccttggcgactttaagttggcagacttcttgccaatctttaaggcagcctacaacaagtaaccctagcaaaaaagcgaatgattgctcattcgcttttttcggctaaatcaatgtcgtacgctacccgattgccggctagttttcctcggtatgtgaaaccacgccgggcgataattgcttgcatctttttatttttttcatgggtatcgatgcgaatgtagtcaaaaccatttgcccgggctgtcgcaaataaatgcgtgaacagctctgtcgacaagtggtagccctggtgttggaatgacaccgccatgcgatggataaccgcatagggcttacgcttggtgggatacagccagcgcccgccttgcagacgctgatagttcacatctttttcttgccaaagcgtggccgtggcgacaatttcatcatcgagttgcaagatgtatgcgtaccctttggcgatgtcggctttgatgatttctggggatggataaccattatcccactgcggattatgatcaatagacatgactgccttagcatctgatataatttgccaaattgcgtctgcgtcagccatggtcgcttgtcggtaagttatattggccattggtctacctcacttcaataagcaacattatacgccgttttcgggcaataattgtcaacaaaaacgtcatacctggttgcgataataacctcagtcataataaatgatttgcggtgaatcccttcgccgcaccttctttcaccactcggtactccttgccgggtggttttttgttgtccgaaaactaaaaaggacaaagcacaacatgtactttgtccttcagtaggttaattagtcttcaaaaccgtcagtcgtcattgatgcttggtacaaagccacaacatcctcaaccgtcaagttcacgtaaccaccctcgtgatccaaaccaccgatttcaactgctgactcagccatcgcacggaagttcgtctcatcgttgatatcaacaccttgcaaagtcgttggcacttccaatgactttacccattcgtaagtggcttggatagccttctcagcaacgacttggtcatcggcatcttggatatcccaaacattgcgtccgaagcgggcaaacttagcaaccgtagctgctgacaaagcacgcttcatccaacgtggcgtcaagattcccaaaccaacaccgtgggtgatgtcgtagaatgctgacaattcgtgctcgattgggtgaaccgtccagccgtttacgtttcctgaacgtaccaaaccgttcaaagccatcgttgaagcccacatcaagttagcacgggcatcatagttatctggcgttgccaaagcaactggcgcccacttgataacggcacgcatcataccttcaatcataccgtcagaaatatctgtgttctcggcacggtcgaagtattgctcagtcaagtgtgagaagatgtcgattgaaccggcagccgtttgccactttgaaactgagtacgtcaattgtgggtccaagaatgaaacagctggtgtgtttggtccatacgtaccaatcttagcgttcaattctgggtttgagataactgaacctgggttcatttcagtacccgttgcagccaacgtcaagatgtcgacaactggcaattggtccaactttgagcggtactttacaccgtggtcagcgaccaaatcccaggcatccccatcataaaactttgctgatgcaatcacctttgatgcatcgataactgatccaccaccaacggccaaaatgacgtcgatgtcgttctccttagccaaacgttgaccctcgcgaactgaatcaatctttgggttaggctcgataccgtccaattcagtgacgttcaaaccttccaaagccttcataacacgctcatacaagccagaacgcttgattgaaccaccaccgtacgtcaacaaaacgttttgaccaaattgggccacggcatcgtgcaattctgcatcgatgtggttctttccaaagcgaatatctgtcttatttacaaagcgaaaatcttccataattgtcgtcctccaatgagttgtgcagactactttacttactaaacgtaacatacactatacacctttaggggacgttaaacaaattctcactacgcaaaaaagcacttcaactagattcacatctaagttgaagtgctttttgttatgaactaacagcgattaaccgagattagtcgttgtgcaagttcattgagttttcaatatcagcgattgaaggaatcttcgtaccctcttcagttgatacaacaacaggatctgcaacgaccttgtcttcaacagcttggtattgcttcataccagtaccagctgggatcaacttaccgatgataacgttctccttcaaaccaaccaatggatcgttctttccacggatagcagcgtcagtcaagacacgagtcgtctcttggaatgatgcggctgacaagaatgagttcgtctccaatgatgccttggtaataccaagcaaaactggacgtgctgtggctggcaagccacccttcaacaacgtctcttcgttagcatcacggaattgcgcgatatccatcaacgtacctggcaacaagtccgtctcacccggatccatgacacgcaccttacgaagcatttggcgagccataacttcgatgtgcttgtcagagatctcaacaccttgcatacggtaaaccttttgcacttcacgcacaatgtagttttccgtagccaacgtgtcacgtacttggatgatttccttagggtcagctgaaccttcgttcaacgtctcaccacggtggatttgatcaccttcggccacacgcatgcgtgcagtcattggcaacgtgtaagtacgcgtatccgtctcaccttgaacagtaacttccttagtacgttctgctgggttttcttcaatagaagtaacctcaccagtaacttcagtaatcatagcacgacccttagggttacgtgcttcaaagatttcttgcacacgaggaagtccttgcgtgatatcgtttccggcaacaccaccagtgtggaaagtacgcatagtcaattgcgtaccaggctcaccgattgattgtgcggcaacagtaccaacagcttcaccaacttcaacaacgtcaccagtagccatgttgcgaccgtagtcgtatacgcagacaccgtgttccgtgttgcaagtaaaggctgaacgaatgttaacagtcgttacgccggcgttgacaatagccttagccttgtcttcgtcgatcatttggttgtgagcaacgatgacttcaccagtcttagggtcgataacagccttttgtgcgtaacgtcccaaaatacgctcgtacaatgactcgatgacttcgttaccgttcatgattgcagaaacatccaaaccacgatcagtaccacagtcgatctcacgaatgataacgtcttgcgcaacgtcaaccaagcgacgagtcatgtaacctgagtcggccgtcttcaaggccgtatcagtcatacccttacgagcaccgtgagttgagaagaacatttccaaaactgacaatccctcacggaagttggcgatgataggcaactccatgatacgtccgttaggcgcagccatcaaaccacgcataccggccaattgcgtaaagttagaaatgttaccacgagctcctgaatctgacatcatgaagatgttgttatcaggctcgaagtgctcaataagcttagcagtaatgtcatccttcgcttggttccagatggcaataacacgctcataacgctcatcgtcagtaatcaatccacgacggaattgcttagaaacagtagcgacttgcttgtgagcttcttcgatgattcctggcttttccttcaagtcagtaacgtcggccacaccaaccgtcaaaccagacttagttgactcatcgtaacccaagtccttcatacggtccaatagcaatgacgtttcagtaaccttgtagatcttgtagacttcggcaacgatgtctgacaagaatcccttcttgaatggaggcaagattggcgtctcagcaaagtgtgccttgatgtcagttcctggctccaagaagaagcggtcgtcaatggcgtgcaagttagcctcagttggctcgttcaagtatgggaagtcgactggcaagatgtcgttaaagaacaacttaccaacagtcgtcgtcataatacgtgaacgttgctcgtcagtgaatggcttttctgcagggaatgaagacgtttgaactccaatacgcgtgtgcaagtgcacatacttgttttggaatgcagtacgagcttcgttgatatccttgaagaccataccttcaccttcacgaccatcttcttcagtcgtcaagtagtagttaccgataaccatgtcctgtgatggagccacgataggcttaccatccttaggagccaagatgtgtccagcggcaagcatcaacaaacgagcttctgcttgagcttcatctgacaaaggaacgtggatggccatttggtcaccgtcaaagtcggcgttataagcttcagtaaccaatgggtgcaaacgcatagccttacctggcactaggacaggttcgaacgcttgaatacccaaacggtgaagcgttggtgcccggttcaaaagaactgggtgctccttgataacgtcatccaagacgtccataacagcgtcatcacgacggtcaatcatacgctttgcggcacggatgtttccaaccaagtcacgcgcaaccaattccttcatgatgaatgggcggaacaattccatagccattggacgtggcaatcccatttggttcatcttcaagaaaggaccaacgtcgataactgaacgtcctgagtagtcaacacgcttaccaagcaagttttgacggaaacgtccttgcttacccttaagcatgtgtgacaatgacttcaatggacggttaccaggaccagttacaggacgtccacgacgaccgttgtcaaccaacgcgtcgacggcttcttgcaacatacgcttttcgttttgcacgataattccaggtgcattcaactccaacaaacgcttcaaacggttgttacggttgataacacgacggtacaaatcgttcaagtcagacgttgcaaaacgtccaccttccaattgcaccattggacgcaagtcaggtgggataactggaataacatccataaccatccactctggcttgttacctgacttaacgaaagcttcgataatgtccaaacgacgaacggcgcgaacacgcttttgaccagtggcctcacgcaattctgccttcaacgtctcaacttcggcttccaagtcaacgtttgacaacaacgtttgtacagcttcagcacccatgccagcttcaaatgcgctaccatattcttgcttcaactcgcggtactcgcgttctgacaacaattgcttttcagtcaaaggtgtatcaccggcctttgtaaccacgtaagaagcgaagtagataatctcttccaatgaacgtggtgacatgtccaagaccaatcccatacgtgaagggattcccttgaagtaccagatgtgtgatacaggagcggccaactcaatgtgacccatgcgctcacggcggacctttgaagacgttacttcaacgccgcaacgatcacaaacgattcccttgtaacgaatacgcttgtactttccgcacgcacattcgtaatccttggtaggtccaaagatacgctcgtcgaaaagtccatccttttcaggcttgagcgtacgatagttgattgtctcaggcttcttaacttcaccataagaccagctgcgaatcttgtctgggctagccagtccgatttgcatgctttcaaacttattgacatcaatcaatggtttgacccctttcgtaggttcctatatacaatccaatccagcacttcactaagtccgtgcttaccatgctcgaatgatcaaacgcagtaagcacgaacctagcaatgtgctaggttggctaacaatctcttaaaagtagcgcagggctaagaataatctcttattcagcgtcgttcaagttaacgacaccgtcagcctttggagctgatgcttcggcaccgtcggcagcaaattcttgtgccaaacgttgtgcttctgcattagcggcttcgatgttaacgattgaatcgtcatcatccatgtcacgcaattcgatctcacgatcatctgcgtccaagaccttcatgtccaaaccaagagcttgcaattccttaaccaagacacggaatgactccggaacacctggcttagggatttgatcacccttaacgatggcctcgtaagtcttaacacgaccaacaacgtcatctgacttgtacgtcaagatttcttgcaaagtgtgcgcagcaccataggcctcaagggcccaaacttccatttcaccgaaacgctgtccaccgaattgcgccttaccaccaagtggttgttgcgtaacaagtgagtaaggtccgattgaacgggcgtgcatcttgtcgtcgaccatgtgggccaacttcatgtagtgcatgattccgacagaaacacgcttgtcgaaggcttcaccagtacgaccgtcatacaaaacagtcttaccgtctgatggcaaaccagcttccttcaaagcgtcccagatatccgcgtcacgggcaccgtcaaagacaggtgatgcgatgtggatacccaattcacgagcagccatacccaagtgcaattcaagcacttgtccgatattcatacgagatggcacacccattggtgacaacataatgtcgataggtgttccgtctggcatgaatggcatgtcttctgaaggcacgataacagaaacagttcccttgttaccgtgacgaccggccatcttgtcaccaacttgaatcttacgacgttgtgcgatgtaaacacgaaccatcatgttaacacctggtgccaattcgtcaccgttctcacgcgtaaagatacgaacgtcttgaacgacaccgccaccaccgtgaggaacacgcaatgacgtatcacgaacttcacgggccttctcaccgaagatggcgtgtagcaaacgctcttcagctgacaattcagtaacacccttaggcgtaaccttaccaaccaaaagatcaccgtcttcaacttcagcaccgatacggataattccgcgctcgtccaagttcttcaattgctcttcaccagtgttagggatttcgcgagtgaactcttcagggccaagcttcgtatcacgagcctctgattcgtattcttcaatgtggattgacgtgtaaacatcatcgcggatcaaacgttcgttgatgatgatggcatcttcaaagttatatccttgccaagtcatgaaggcgatcaatgggttttgtcccaaagccaattcaccttgctccattgatggaccatcggccaaaacttcgtcggcatcaactgcatccccaaccttaacgattggacgttggttgtagttcttaccagcgtttgaacgacggaacttcatcaattcgtacttatcaagtgaaccatcttcgcgacgaacgcggatttcgcgaccgtcaacgtactcaaccgtaccagggtacttagcaataatggcaacaccggcgtcgtgggcagccttgtattcgatacccgtaccaatcaatggtgcgtgtggatcgatcaaaggaaccgcttgacgttgcatgttggcacccatcaaggcacggttagagtcatcgttttccaagaaaggaattgcggccgtggcaacggcaacaatttgcttaggagaaacgtccatgtagtcaacttggtcgatagaaacttcgacgttttcctcactcttacgagccaaaacaacatcagaagcaaatgatccatcttcgttcaaaactgagttaccttgggcaacgatgaagttatcttcttcgtcggccgtcaagtagtcaatcttgtccgtaaccttgtgagtcgtccagtcaacacgacggtatggcgtctcaatgaatccgtaacggttaacacgaccgtacgtagccaatgagttgatcaaaccgatgttaggaccttcaggcgtttcgatagggtccatacgtccgtagtgcgtgtagtgcacgtctcggacttcataaccggcacggtcacgagtcaaaccaccaggtcccaaggcagatagacgacgcttgttcgtcaattctccaagagggttagtttggtccatgaattgtgacaattgtgatgaaccgaagaactccttaacagctgccacaacagggcggatgttaatcaattgttgtggtgtaaccgtatctgggtcttggatagacatacgctcacgaaccacacgctccatacggctcaaaccgatacggaatgtgttttgcaacaattcacccacacgacggatacgacggttacccaagtggtcaatgtcgtccgttgcgccgatgcccaatggcaagttcaagaagtagttcataccagcgataatatcagctggttggatcgtacgaacagattcgtcaaattgaccgtttccgatcactggcaaaaccttttcaggatcctctgggttttcaaccaagatagtttgcaacgtcataggcgtcgtcacaacaccttcgtctgaaggcgtaaatgtcgtcgtcttaaagtcgtcgcggtcaaggaatggtgccaaagcagccataaccttcttgtcgataaccgttcccttttcggcgataacttcaccagtatcagggtcggccaacgtctcgcccaacgtcaagcccatcaaacgcgtcttcaatgacaacttcttgttgatcttgtaacgaccaacaggtgccaaatcgtaacgctttgggtcgaagaagcgagccgtcaacaaggcacgagatgaatcggccgtctttggctcacctggacgtaggcgttcgtagatgtccttcaaggcctcttcgacacgtgagtcgttgatgtccttgtgaacgtccttatccaacgtcaatgagattgaatcgtattggtcacccaagatttgcaaaacctctgaatctgatccgtaacccaaggcacgaaccaattcagtaacaggcaacttacgcgtacgatcgatacgtacgtagctcaatccctttgcgtctgtttcaaattccaaccaagcaccacggcttgggatgaacgtcgtaccgtagttaggacgaccgttcttgtccaattcctcgttgtagtaaacaccaggagagcgaacaagttgtgaaacgataacacgctcagctccgttaatgatgaacgtacctgatggcgtcatcaatgggaagtcaccgaagaacacgtcttgtgacttgatttcaccagtttcttggttcgtcaagcgcaacgttacgtgcaatggtgctgagtaatttgcatcgtggttacgagcttcttctactgtgtacttaggctccatgagcttatagtccacaaattccaatgacaactttccttggaaatcttcaattggcaaaatgtcagtgaacatttcacgcaatccttcatccaagaaccagttgtatgagtccgtttggatctcaatcaagttaggcaaatcaaggacttccttgattcgtgcgtaactgcgacgaacacggtgcttaccgtactttacaagcgttcctaccaagttttccacctcgctttgatttggccaactgcgcacaccagtttctttacagtttgattacaaaatctgttttttaccggtttttgagtgcaaaaaagacaacgacatttccgacttcgaaaacgccactgcccctgctataaaggctttcagggacaatatttcctgtcagccgttgtctatgcacaattaaactaccttatagtatacaagaaaaagcaagcattatcaaggtttgcgtcctttgtcaatactcgctttttcaaataaattatggttattctgtgaccgtctcttttggctcagcctttgccttcacgttaatcgtgatttcgccggccttcgcaccgattgtcacaacatcattcgttgtaattttgccgctcaacaattcttctgacaaacgatcttcaaccttcgtttgtagcgcacgacgaattggacgggcaccgtattcaggatcgaagccagcttccgccactgcatcaattgcagctggcgtcatcttaacatcgaagccttgttctgaaatgcgcttcaacactgacttggccatcaacttcacgatttggtgtagttctggcttcgtcaaagcgtggaagaccacgacttcgtcaatacggttaataaattctggacggaacgtctcacgcaatgtttgtcgaacagtcgcattcattgcgtcgtagtccttagacttgtcgaccgcaccgaatccaactgacttctcatcacgcaaacgcgttgcacccaagttagacgtcatgatgataatcgtgttacggaaatcaaccttacgtcccttggcatccgttaggtaaccatcgtcaaacacttgcaacatcaagttgtagatgtctgggtgagccttttcagcctcgtccaacaggacaactgagtatggattacgacgaaccttttcagtcaattgaccaccttcgtcataaccgacgtaaccaggtgctgaaccaaccaaacggcttgctgagtatgcttcacggtattcagacatatcaacacgaatcatgttgtcttctgaaccgaacattgcttcagccaacgccttagccaactcagtcttaccagttccagtaggtcccaagaacataaacgttccaattggacgttgtggatccttcaaacctgaacgggcgcgacggatagcgcgagcaattgctgaaacggcttcgtcttgaccgatgacacggtcgtgcaaaaccttctccaagttcaacaaacgctcttgctctgacttctccatttgcgttagtggaataccagtttgctctgaaaccacttcagcaacatcgtgcgtcgtgacttccaagtcgtagtttgacgtaccttcaggttgctcagcatcacgctcggcgatgtacttatcaaccttcttcttttgcgtcatttccttcttacgaagttgggctgccaattcgaagtccaaagactcgatagcggcatccttttccgcacggatagcttgcaacttttcttcaagcttagccaatggcgtcttgtgacctgaacgatcgatacgcaccttggccgcagcttcgtccatgatatcgatggccttgtctggtaagaagcggtccgtgatgtagcggacagacaacttaacggcatcaactaccgcatcatctgaaatggcaacttggtggtgttgctcataacgtgacttcaaacccttcaaaatttcaatggcgtcagcttccgttggctcatcaacttgcacttgggcaaaacgacgctccaaagcagcatcagcttcaatgtacttttggtactcatccagcgtcgtcgcaccgattgtttgcaactcaccacgagccaaagctggcttcaagatgtttgaggcgtcgatggcaccttctgcaccacctgcaccaatcaacgtgtgcaactcatcaatgaacaagataacgtttccgtcgcgttggatttcgtcgataaccttcttcaaacggtcttcgaactcaccacgatacttcgtgccggcaaccaaagaacccatatcaagcatcatcaaacgcttcttagccatgtcagctggcacatccccagcgacaatcttttgtgccaaaccttcagcaatcgccgtcttaccaacaccaggctcaccaatcaagactgggttgttcttcgtacgacgtgacaaaatttggatgacacgcttaacttcagcagaacgtccgacaactggatccatgcggtgatcacgcgcttgttgcgtcaaatcacgagccaatgaatcaagcgttggcgttccttcttgtgcttgttggttaccacgacggccgccacgagcatccttcttgcgcgccgtatcattgataccaagcttacgcaaaatcacgcgacgcatttcaccaggatttgcatccaatgaaatcaagatacgtgatgacaaaattgagtcgtcggccaacaatgccaacaagatgtgttctgtaccaacacggccttgttgcatgttgcgagcttcttcaccagccatttgcaacacttcaccagcctttggtgagtatggcaagtaagcttccttttcagcacgtgacaacgtaccgtaaccagtgaagcgctcaatctcctcacgaatatcatcgtctgagatattaaattgttgcatcaccttgctagcgataccttccttctcgatggccaaagccaacaaaaggtgctcagtaccaactgcttggtgcttaaaatactttgcttgttcttgcgccaaaacaagtacgttcttggcgcttggtgtgtattgattatccatattaattacgctcactttcaaaccgcattcggtttaataattgacgtagcaatcgtccgcgtagacgtccttcaacttgaacatccccaacgtccaacgcttccttcgacaacattgtcagcaacagctcctgctcccgttccgttaataactcatcacgtactaaacttgataagatatcgcgaacctcacgaacactcacttgatcagaaagacttgataacaactcttcaatataacgaggatcagccctcagtggcacccgctcaatacgaataaagccaccgccaccacgttttgaaatcacgtgatagccttgttgaattgaaaaacgtgtcttaatgacatagttgatctgtgaaggcacaacgttgaatcgttccgcaagctctgcgcgccgaatttcaatctgttctgattgctgcaaaatctgtttgagatatgcttcgatatagtctgacatattttgttcagccatcttcgtgcctccttgaccaatgttgacattattatagaacgtgcggttcactaatgccaataattcgtcatgtcgtttctgacttatggtaagtttaccattaaacacaaaaaccaaacaaaaaatttcacacttaatcgattatgtaaatcgtaccaaacaagtttgcctattcagttcgaaatcttgtggtaaaacacgacagaaaaaccaccaagttattacttgatggtttttccaatcgatgggcctagcaggactcgaacctgcaatacccggttcgtagccggggtgtttatccaattagcatataagcccattatttaattatttgatcctataaagaatcagaagcgaacaacgggattcgaacccgcgacctctaccatggcaaggtagcgttctaccaactgaactatattcgcatcaaatgccgactactggattcgaaccagcgaccccttcattactagtgaagtgctctgccagctgagctaagtcggcatgtctatcggtaaaccgataatacggatgacaggaatcgaacctgcacgcccgaaggcactggaacctaaatccagcgcgtctgccagttccgccacatccgcaacagacgtcttttcaagttattcgcttgaaacaacttttatataataacaagtacagaagcaagtgtcaacacttttttcaaactttgttattttggaacgcttggcagcggccccggtaggcatgtcgcctaaccacttgatatataatactcgcctcgctgtcttttggcaatacttttttcatagaaaaagcgcatttcatacaaaaaaggtgaccacccattgtgatcacctctatctctaattacttagttgccgtaatgtcgtagttgctcttgccgaacataccacgccaagtcgttgcgaaccagtttgcacgcgcctcttctgaaactgaaaccaactcaacttcaggggctcccgtcaaccagtcgttggctgccgcaaatgatgattccaattgcgccgttcccaacttctcgttttgcttcaatggtgctgtaaccttcttgctcaacttcacgttgactgcctttgtcgttgctgactcaccagctggcacgaagaatgaagctgttcccttagtcttgtatgaaaccttgccatccttagccgtcaaaactgagaccgtgttcttagctggcttcaaacctgaggccaccttttgtaccttaacagcatcatcagccttcttaaccatcgtcaacgttgcgttaaacttggcagccgcatcagcgttgtcacctgagttcaaaacaactgagacaactggacggccttgaatcttcgtcacaccgacaaagtttccacctgcattaggcgtcgttcccgtcttcaacccaagccagttcaaatcaaacgtttcgttacccaacaattcgttcgtgttgttcatcgtttcagtaccacctgaaaccgcagggaactcaaccgtcttttgttgtgccgtcttcaacacatcagggaaatcaacgaccaaacgacgagccactaccgccaattcacgagctgacatttcgttttcaacatcatcctcagctgatgcatccttaaacttcttcatgtcgccgttcgtcaaacctgatggtgagtaaatcttcacgccagcaatgccccagctctccaacttagcttccatcatcttctcaaacttagcttggctaccacccaacaagttcgccaacaacaaagcagcaccgtttgaagatggcaccatcatcgcgtcgatcaattgtagcaccgtgtacgtcttctcagccgttattggcgtgttagccactgacaagtcttgactgaaggcggcgatgtcttcaggcaccttcaccttttgtgacaatgaaatcttacctgacttgattgcttccttcaccatgtacatcgtgatcaacttagtcgttgaagcgattggcaaacgctccgttccattttgatcagcaattacttgaccagtttgggcgtcaaccacaacacccgccttcgttgattgtaggcctgggtcaaccaacgctgcactcgcgctcgtcccaactgatgccaacacacccgctgccatcaaacctgccatcatttgcttcgtaaccttacgcatatcttttccccactcttatcgcgccacagtcatcattccgtaacgcattacttaatatacttattatttacaaataacttatgcattatttgcctgaaatatgaagaaaatgtggtcgtgtggaaaagttagtttgtggttagtgtccgacctgttcacccatgcctcgacgcaacgcgtcgaatctcactactaacaaaaagcccaacaaccgaaatccgattgttgagctaaattaatgtttaattttacaacgtgtcttctggcacgatcttgtcggcaccgaagtatggacgcaaaacttcaggaactgtaaccgttccgtcttcgttttggtagttctccaagatagcagcaaccgtacgtccaacggccaaacctgaaccgttcaacgtgtgtacaaattgcaacttaccttcttcgtcacggtattggatacgtgcgcgacgagcttggaaagcttccgtgtttgaaactgatgaaatctcacggtagatgtcttgctcaggcatccaaacttccaagtcataagtcttggcagctgagaatcccatgtctcccgttgacaacgtgatgacgtggtatggcaagttcaacttttgcaagatgttttcagcgttagccgtcatgtcttccaaagcttggtatgattgctcaggcttcgtaaacttaaccatttcaaccttgttgaattggtgcatacgaatcaaaccacgcgtatcgcgaccggctgaaccagcttcttgacggaatgatggtgaaacagccgtaactgagtatggcaacttgtcagcatcaattacttcctcacggaagtagttcgtcaaaggcacttcggccgttggaatcaacgtcatgtcgtcgtttgttccaacacggtaggcgtcttccatgaacttagggtattgtcccgtaccaaacatagcagcatccttaaccatgtatggcgtgatcatttccttgtagccttccttttggtgctcgtccaacatgaagttgtaaacggcacgctctaggcgggcaccttggccaacgtagtagacaaagcgagcaccggcaaccttagcaccgcgctcccagtccaagataccaaggtcttcaccaatttcgtagtgggcctttggcttgaagtcgaatgaaggaatttctccccaagtacgctcttcgcggttagcttcttcgtcagcaccaactggaatcgttgggtttggcaagttagggaagtgcaacatgcggtcttggattgccacgtcaaccttagcaacttcttcgtctaattccttgatcttagcagatactgcttgcatctcggcgatagtctctgaagcatcttccttgttgcgcttcttcaaaccgatttcgtctgaaaccgtgttacgacgagccttcaactcttcagtttgtaccaacaattcgcgacgcttagcatcgtcagcaatcaatgcatcaatttctgatgggtcaacaccacgcgttgccaaacgttccttgacgctttccgtttcgttacggatcaacttcatatctaacatattcttattctcctaattaatcacgcaaacccaattcatcaatcttttcgtcgatcaatgccaaaactgccttggcagcttctgggtcattcacaaagtcgtgcttgtcaccatcgatacttagctttggtgaacgatcataactttcgaaccaagcaatgtagcgttcgttcaacttcttgtagtagtcgtacaatgatggatcatggtcgatttgctcgaagtcgcgaccacgcttttgaatgcgggccaacatcgtatcgaagctaacgtggatgtaaatcaacaaatctggcgtctttacgatagcgtcgtcagaaaaatcaacttgctccatcatgttgttcaacaaatcaccgtagatagcaacttcagtttgcgttgcacgttccaagtcagcgttcaattggaacaacaacaagtcctcaaagattgaacggtcgataacgttcaacttgcttccttgtgcgtccttgatgttatccatacgcttgttcaagaaataattttgtagcaagaacgcgtacttctttggattctcgtagaacaaaggcaaaattgggttgtcatctacggactcataaaatgcttcacttcccaagtgctcagcgagcatcgtcgtcaaactggtcttcccagctccaatagttcccgataatacaatcatcgtgtcgtcctgctttctcaaatcataattaattctattttagcaaattttgcgcgtgcttaaaactcccttatttggttaagcggtcgctatattttgccgtgtactcttcaagtgctgggatgtcatcgctcttatacttgttgtaatcaccaccagcattacctgtgtattgttcaagggagatattttgttccttaataaccttagccgctgtcatgccaacatagcgcatgtgccattcctcgtgagaatagccggttgagctcgttaagtcagctgggtaacggacaatcaaaccatacttgtaagcattgtcacgcaaccacttagctgcagctggatcagaaccaccttctgcaaacaaaccaccgctaccgttacgcaagtcgaatgccaaaccggattggtgttctgagtagccaggtcgcgctgataccgcatcggcttcagcttggccttcagacgcaacgtaaccatcgtacaacgtcttttgataatcatagccacggtagccagacactgtatcaccaacatcaaagccagcttgtttcatggccgcaatcagttggtccttggccgtttcagtacgaggactcaagccaccgttatatgggttgtaatcagctggcaatgggtgcttcttattcacaaccatcaacagcgttgcttcctcgctacctggcttaatcgtcaccggataagccttcttttcactgcttgattgttgctttgctggttgctttgtcgtcgtttgcgtcttctcggctggttgatcttggcgcaataaccaataaccaccaccggccaacgctacgacaaccagaccggtaccaacaagttttccaaatttcattctcgcattcccctcacaatatcgttgcttctagtgtaccattttgtatacaaaaagggccttgaacaaaatgttcaagacccttaaattcgcaatctattacttctttccagaagcaacgtggatacggtttacggcacgcaacaaagcgacctgtgcgcgttccacatcacgagttgagttatcatcagccaaacggcgctcagcgcgttccttggctgactccgcacgagtaatgtcgatgtcagcagcacgctctgcagcgtcagcgacaaccgtcaactcgtttgaagaaaactcggcaaaaccgccactaacggcaaggcgttcttcaacaccgttgacgtcatcgacaatcttaacttcgctaaccttcaaagcagcgataattggtgcgtggttcgccatgacacctacttcaccgccagtcgtgctaagcacaaccaacgtagcagtctcataatcgaacacgacaccgttcggcgttaccaccttaacatgtaggctgtgttcattcatggcgcgccctcactattgagccatcgtagcagccttttcagctacttgttcgatgacaccaacgttacggaaggcatcttcagggtattggtcgtacttaccttccaagatttccttgaagctacgtacagtttcagcaactggtacgtactcacccttcaaaccagtaaacgtctcagcgactgagaatggttgtgacaagaagaattgaatacgacgagcgcggttaacgatcgtcttctcttcatctgacaactcatccatacccaagattgagatgatgtcttgcaactcacggtagcgttgcaaagtacgttgtacttccgtagccacttcgtagtgttcttgaccaacaatctcaggcgtcaaagcagttgacgttgatgccaatggatccacggctgggtagataccttgttgcgtcaaagcacgctccaagttagtcgtggcatccaagtgggcaaatgtcgtcgcaggagcagggtcagtatagtcatcggcaggcacgtaaacggcttggattgacgtaactgaccccttttgcgttgacgtaatacgctcttgcaattgacccatttcagttgccaacgtaggttggtaaccaacggctgatgggatacgtcccaacaaggctgaaacctctgaaccagcttgcgtgaaacggaagatgttgtcgataaacaacaacacgtcttgtccgttaacatcacggaagtgctcagcgattgtcaaaccagtcaacgcaacacgcatacgtgctccaggaggctcgttcatttgaccataaaccatggccgtttgcttcaaaacgcctgaatcttgcatttcgtggtacatgtcgttaccttcacgggtacgctcaccaacaccagtaaatacagagattccgttgtgaccttgagcgatattgtgaatcaactcttgaatcaaaactgtcttaccaactccggcaccaccaaacaatccgatctttccaccacggatgtaaggtgccaacaaatcgataaccttgataccagtttcaaggatttcagtagatgtggccaattggtcgtaagctggggcctcacggtggatagggtcacgaggaacatcctcacccaactcttcaccaccatcaacggggttacccaaaacgttgaacacacgtcccaacgtagcttcaccgacaggcacactaattggtgcattagtgtcttctacggccattccacgttgcaaaccatcagttgagtccatggcgatcgtacgtacgacaccatcacccaaagccaaagatacttcgaccgtcaacgtaccttgctcacccttatcgatgatcaaagcgttgttgatgtcaggtacttgagttcctgatggaaaggcaacgtcgacgactggaccaatgacttgaacaacacgtccggtactcattgtcgtttccttccttcatttcaaaaggttgttatgacgcttggattaatccaaagcagccataccacctgtaatttctgtaatttccgtcgtaatcgcactttgacgcgcacggttaaattgcaattccaacgtacggatgatctccttagcgttatccgttgcagatgacattgcgttggcagaagccgcgtgctcagccgtcttggcatccaagatagcaccgtagaccaaactctcagaatattgtggcaaaaccacaccaagaatttgttctggagaaggatccatttcgtaatccgccttcactgaatcttcagacgttggttccatgtcgtcagtagaaactggcaacatcttctccaaacgcaattcattttgaattcgtgatacgaagtgttggtatgcaacagtcaactcatcaaagacttcgttatcgtacattgtcgtaacggtcttaacgatttcgcgaacctcgttaaaggtaggcacgtcagacacaccacggtattcgtacgcaacgttgtagccacgcttcttgaagaagtctgaggcattaccaccaacggccaaaataaccacttggtcaggcgtcaattgacgctcttcgataatcgccatcatacccttcaatagcgttgagttataaccaccaaccaaaccacgatcagaagagatgaccaagaagccaaccttcttcacatcacgttgctctagcaaagtaccagaaacattgttgatgtgcgcattagataagtgagccacaacgtcgtgcaaggcgttagcatacgttgtgtatgatccaccgtgacgttgaatttggctcaacttagccgttgagaccatttgcatggcactcgtgatttgtcgcgtcttttttgttgaggcaattcggcgttgaatatcttgcaaagaagctgccatttatcgcccctccctaattattgggcacttggcgcaaaggttgccttgaactccgtaatagcggcgttcatagcatctgcatcaggcaagtcctttgtgtcaacaatcgtttgcaacaattcgttgtgtgaagcacgaacagctgcgatcatttctgattcgaagcgttggatatcttcaacagcaacatcgtccataaagccacgagtcaaggcgtacaatgacaaaacttgctcttcaactggcaatggttggtgcaaaggttgcttcaacaactcaaccgtacgacgaccacgggccaacttagcttgcgttgccgcatccaagtcagaaccgaattgtgcgaatgactccaactccttaaatgaagccaagtccaaacgcaacgttccggcaaccttcttcatcgccttaatttgggcgtcaccaccaacacgtgaaacagaagttccggcatcgatggcaggacgaacaccggcgtagaattggtcggcatccaagaagatttgtccgtcagtgattgagataacgttagttgggatgtacgcagaaacgtcacccgcttgcgtttcgataactggcaaagcagtcattgaaccgccacccaattcgtctgacaacttagcagcacgttctagcaaacgtgagtgcaagtagaagacgtcaccagggtaggcttcacgtccaggaggacgacgaagaatcaatgacagctcacggtaagccgtagcttgctttgacaaatcatcgtacacaatcaagacgtgcttgccgttgtacatgaactcttcacccatagctgcaccggcataaggagccaagtacaacataggagctggttctgaaggaccggctgacacaacaatcgtgtaatccaaagcgcccatttgacgcaaagtttcaacttgcgtacgcacagttgaatccttttgtccaatagccacgtagataacgatcatgtcttgatccttttggttcaagattgtatcgatggctacagacgtcttaccagtcttacggtcaccgatgatcaattcacgttgtccacgtccaattggaaccaaagcgtcgacggccttcaaaccagtttgtagtggctcgaaaacagacttacgctccataacacctggggcctttacttcaacaggacgagtgctcgtcgtgttaattggtcccattccgtcgattggttgacccaatgcgttaacaacacgtccgatcaatccctcaccaacaggcacttccatgatacgaccagtgcgcttaacagtatcgccttcgcgaatctcgtcgtacttacccaagataatgataccaacatcattagactcaaggttttgtgccataccaaatacgccgttctcaaactcgaccaattcaccggcaagagcgttctccaaaccggttacacgggcaataccgtcaccaacgtaggtaacagttcccgtttcttgaacagtcaattcgtcttgatagttggccaattggctcttgatgagtgaactgatttcttcagctttgatgctcatttcagcagttcctctttctttaaagtgtgtctattcatcacacacaacatcaatttctactagattttcagattactagcggatgatactctgacgaatagcagctaacttagttgctaatgacccatccaaaatctggttgttcgcttgtacaacaacaccaccaagcaaggcctcgtcgacaacttgtgtcaacttaatctccttagcttcaaagcgctttgcaagttgttccgtcatacgggcagcttgttcgtcgctcaaagcaacagcagtcttaacctcggcatataccacaccttcagacttgttaaccaagtcttcgtaagccgtgataattgcaggtaggtcgctgaaacggcgataatcatacgccatttgcaacaagttcttaaccacttggctagctccatcagatagcgttgctaccatttgttgcttagctgactcaggcacacgcattgattcgatagccttcgtcaattctgggttttccaccaatactgtacgtacttcaaccaattcggccaaagttgcagcatccgtgttttggtcatgggttaattcgaacaaagcaacggcatatcgcttagcaatcgttgcttgatccaatgccattacttgttacctaacccttcgatgtaggcgtcaatcaacgccttttgatcatctaactttagttccttttggataatcttttgtgcgatcgtcactgacaactcagcaacatcgttcttaacgccagccattgcttcggcacgctcttgctcgatttgagctgaagcttgatccttaatagcttgggcagctgcgtgcgcgtccgcaacgatttgatcacgttggtttcctgcagcagtcttagcgtcagcgatgatgccgtttgcttcagtgcgagctgattgcaattgagctgaacgctcagctgcatcggcttcggcttgcttacgggcctcttcagcagagtccaaatcgttagaaaccttttccgcacgcttttccatcatctttactactggaccccaagcgaagtgcttcaaaagaagcatcaacacaaggaatgccactagtacaaacaacatgttacccaaagccaacccttcgctagcacctgctagaacaatttgattaatcataattagttggcctccgcgttactattacttgctcaacaacatgaaggcaatggcgatggcaatgataggcacggcctcgaccaatccaacaccgatgaacatgttagaacgcaacttaccttccaattcaggttggcgagccatacctgagatcatgcttgaaataacaataccgttaccaattccggcaccaattgcggcacccgctgcggcaacaccaacaccaatggttgcaacgtccatttttttaatcctccgattaattaagaaaaaattactcttcaatctcagtcttttctgaaacgtaaactgtagtcaacgtaacaaagacataagcttgaatacttccgacaaacaaagagaatgcttgccaaatcatcgttagcaagaatgctggaacgaatgatacgacaccggctgattttgccaattcccaaagaagagacaagaccatttcaccggcaaaaatattaccgaacaaacgaagtcccaatgtcaagaaactcgtgaattgttcaataatgttaattggcagcaatgcgctgaatggactcaagtaaactgacttgaagtagtttttgaatccgagcttttgaacacccaagtagtgggacattccgattgcaatcaatgccaaggtcatcgtgaccaacggattagccgttggagaacgcaagaacgttacgtcattgaagtcaaccacgaaggcaacacctaattggttggcaacaaagatgaacatgaacattgagaatgcgaagaactttaaattagttccagttcgatttggaagcgatccatcaacgataccgttggtaaagtcgataatccattcaaggaagttttgctttgatgcaccagctggcttcataaccaacttacgtgacatccaaaacgccaagaagaaaacaatagcgaatgtaacagtcgttgaaataatgatgctccagtcgaacgttagccccgcaatgctaaaggttgcggtcttctcacccacagaaatccacctctttcctttctaaataatcgcggtgatgcgcagaacacagaccgtttaaaacttttaccccctaatattacgccttttaattgcgaattcaacgttttaagcttcaacacttttgtcccaaatgtgcaatcagatttagaaatgccgtaaaaccgcggttttaaacattccacttcggaatagatttatatttatatccataatttgatattttagatattataaaaaatagcataatcctaggcgtaccaacgcctattcccgctttttaaaggaaaaaaccgcggtattccatatcggaaaccgcggttttactttgtataattattaactatttctctgaagcagccttttctggcaagaccaaattcaagaaaattcccaaaatagtggcgatggcaacaccagagaattggatgatgtcgttaccctcacctacttgtaggtaagcgttaccgataccgataaccaaaactgatgatgcaatcatcaagttacgcttcaagttgaagtcgatcttgttttcaacgatgatacgcaaacctgacgcagcgataacaccgaacaacaagaatgacacaccacccgtaacagcgccaggaattgattggatcaaagctgacaacttaccaacgaatgagaacaagatggcgaatacggcggcaccaatcaaaacgtaaactgagtgcaccttcgtaatggccataacaccgatgttttcaccatatgacgtcactgaaggtccaccgaccaatccagcaaagattgaggcagtaccgtcaccagccaacgtacggtgcaaacctgggttgcgcatgaagtcgcgtcccgtcaaatcatccaagaccatcaagtgacctaagtgctccgtgatcgttaccaaagccaatggcgccataacgatgattgcgccccagtgcattactggcttgtaatcaacgaacggaatgtcgaagtctggcaaggcgaaccaagcggcgtgcgcaactggtgccaaatcaaccaaaccgaacaagatggcgaagatgtatcccccaacgattcccaacaagattggaatcaaaccaaggaagcccttcaagaacatgttgaagacaatcgtcaatcccaatgtaatcatcgcaactgcgaagacgcggatgtcgtacttgccgttcaacaacgttgctgattgcgcagctgatgatgacaatgacaaaccgataaccatgatgattggtcccaccacgattggtggcaacaacttttcaatccagtttgtaccgattaaggcaacgatggctgccacaatcaagtagacgataccaactgagataacaccagtggcaacaccagggtatcccgtggtcttcatcaaagccaccatcggaatgatgaaggcgaaactagaacccatgtacgctggaatttgcttcttcgtaatcaagatgtggagcaaagtacccacaccagaactgaacaaggcaattccaggattcaaaccaaccaacaacggtaccaaaaccgttgacccaaacattgagaacatgtgttgcaatgacaatccaatccattgcaagaacccaggcttctcattaacgtcaagtacgacgtcacgcttcatatccatgagcaaactcctctttaattcccgtctttatacaaaaaacagccaggacgactatgtcatcccagctgtaaaaaatcttctaacgtacggttgcacgttgacccgaacttgtcagtctcgctgggctgacttaaagacgtcttttcttaacttcacttagtataaactagttaacaaagttagtaaacaagtcagctccacgttaaacgtttaaccttttatattaaattgacttaagcgtatccaaggccaacttaatgtcagtttctccttggcgcattgaaatgacgcggtggaatgtgttctcacacttcaacatttctgacaacaccttagccacatcggcgattgtgttcttgcctgtaccggcgttctttggattcaaatcaaccttacccgtggctggttcttcaaccaacccaactggttgcaaaatcgtgtagttcaattccgtgtggtccatcaaccagtgatcaccaaagaacttcgcaatgttgtagttcatcatactctcgtcttgccattcggctggtgacgttgaatgccatgatgacaacataataaagcgcttgatgcccaacttatcagctgccgtttcgagcttcaccgcaccaaaggcatcaatttgtaacaagttcttaccacgtgagccagccacaaagtaaatggcatccaattccaatggacgcaactcaccaaccaatgttgcttcgtctgccaacaaatcaatgttctttaattcaacaccttcaccaaaatcttggtccgtgtgacgcgttcccgcaatcacttggcggccatccgccacaagattcttaaccaactcttcgccgacgcgcccactagcgcctactactaataccttcatcgcacatctcctcaatttctattatcatcttcacaactattatcaaagacaaaaatggagaccgcatgaattaattcttgcagtctccaaattttctttaactaattagtgagtaccgaacaaacggtcacccgcgtcacccaaacctgggatgatgtatccgtgctcgttcaaaccttcgtccaaaccagccgtgtagatatcaacatcagggtgggccttttgtacagtctcaacaccaactggtgcagaaaccaacgtgatcaacttaatcttagttgcaccgcgcttcttcaaagcgtcaatggccatcacagctgaaccaccagtagccaacattggatcaacaaccaaaacttcgcgttggtcgatgtcttctggcaacttaacgaagtattcaactggctccaatgattcttcatcacggtacataccgatgtgaccgatacgtgcagctgggatcaacttcatgattccgtcgaccatccccaaaccagcacgcaagattggcacgatggccaacttcttaccagccaattgcttttgcgtcgtcttggcaactggtgtctcgatttcaacatcttcaactggcaaatcacgtgtgacttcataggccatcaatgaagcaatttcatcaacgatctcacggaactccttcgttccaacattcttatcacgaataatcgtcaacttgtgttggattagtgggtgatcaaaaacagttagcttgctcatgtcatgtactccaattcattttctactattatacaggtaattgttattcagcgtgttcaattccactcaatgggaacttatccgtcaacgtaataacttccttcgcaatcatatcaagaacttcttggttatcgtggttctcaaaggcacgcaaaatcatgtgtgccacttcgcgagcttcatgctccttgaacccacgcgtcgcaattgctggcgttccaatacggatacctgatgtgatgaatgggctacgaggctcatttggaatagcttccttgttggtcgtaatgtgaatgctgtccaacaagttttgggcttccttacccgtcaaaccagtggccgtcaaatcaaggttgaacaagtgattgtccgtaccaccagaaatgacgcgaaccaaatctgattggctaaacacttcagccattgccttagcgttagccacgatttgcttaccgtattccttaaagcttggttgcatggcttcgtagaacgcaacagccttaccagcaatcacgtgttccaaaggtccaccttgcgtaccagggaagatagctgagttcaacttcttacccaactcttccttggccaaaatcataccaccacgaggtccgcgcaatgtcttgtgcgtcgttgtcgtaaccacatcggcgatgccaactggtgatgggtgaaccccagcagcaatcaaaccggcaatgtgcgccatatcaaccatcaagtatgcgccaactgaatcagcgatttgacggaaacggtcaaagtcaatgaaacgtgagtaggctgatgcaccagtcacaatcaacttaggcttaaattcttcagccaaagcttgcacttggtcgtaatcaatcaactcattctcatccaaaccataggcgtggaattggtacgtcttacctgagaagttaaccggagaaccgtgcgtcaagtgaccaccagcgtcgaggtccatccccaacacgtggtccccatgctcaagcaaagctgcataaacagctgcgttggcttgtgaccctgagtgtggttgcacgttggcatagtccgcaccgaacaattccttggcgcgatcaatcgccaattgctcgatttggtcgataaactcagttccaccgtagtaacgcttgccaggataaccttcagcgtacttgttcgtcaaaatgctaccttgcgcagcacgcacccctgctgatgcaatgttttcagatgcaatcaactcgatgttgtgctcttgacggtcagcctcgcgatcaacggcagcccacaactctggatcaaactcacgataatttgtcattcacatgacctcctattaaatccccaaatataaacgatatccccaaaattaatcagctaacagttccgttacccaatgaccgccggaagactttccaagacggttattgtaggcactgttctctggtgtcgatggcatggcagccaccaaaaccgtgcgcacatccttgcgatcatcaaagtaacgcaaacctgcgaacaattttgctgctgcggtatctccattatccccgagagaccacacaaagtccatgccagccaactggtgttgaataattaaatcattcgtcaacatcaaaccaaccggttccaattgtccttgggcccaaatgatggcttgcgtccagtcttctggcgccaccatgtacacatccttatcaggtgcgtagtggcggtacttcatccctggtgccttgggcgcttcatcagcatccacgtgacgaatttctgaatcaaccgccacacctagcacatgttcaatttggccaggtgtaatcttacctggacgcaaaacggctggttggtcagtcgataggtcaatgaccgttgattcaaccccgattttcgttgccccatcatccaagatgccggcaatcttaccatgcaaatcatggtaaacgtgttgcgctgtagttggtgatggcttacctgatgtgttcgctgatggaccaaccaatggtgcatcagcctcacgaatcaacgcacgcgtcaaatcgttatctggcatacgcgctgccactgtgtccaaaccacctgtcaccgtcgttgaaaccgtgccgggcttgactggcaaaatcatcgtcaatggaccaggccaaaaggagtccatcaacttctttgcccagtcgttcacctcagcaaagcggtcaacttgttctgggtcggaaacgtgcacaatcaatgggttgtcggatggacgaccctttgcagcgtaaaccttaccaacggccgtatcgttaaacgcatccgcgcccaacccatagactgtttcagttgggaatgcaacgagcgacccacgcttaatcgcgcgaaccgctgcgggcaattcatcagctgaccaaatttttgtctctgccatgttatgcctcccgtgacactttaatcatgcgatcatgtccactcatgtcttggcgcaatgatactgagacacctggcaactcgccaaagaccgctagcaaagctggtccttgttgatacccaatctcaaagtatgctgctccttgtggacttagataatttaatagttcggcagccatcttcttgtacaaggccaaaccttcgtcgtccgcaaacaacgccaaatccggctcgtacataatgactgattcatccatcacgtcgcgctcttgctcactaatgtaaggcgggtttgaaatgatgatgtcgtattgacctgaagccgcactaaataagtcactctcaatcaattgcacttgcttggcaaattgttcagcgtttgacttggcaacttcaagggcgtcaactgaaatatcagcgcccgtcacatcccaagttgggcgttcagccccgatggttaccgcaatggcacctgaacctgtcccaatatcaaggacacgcttaggttcaccactggctttgtaatcattgaggacccattccaccaactcttcagtttcttgacggggaatcaatacacgtcgatcaacgttgaactcgcgcccgtagaaagcagcgtggcccaatgcgtattgcactggttgaccacccttgatggcacgcacggccaccatgaaacgcaagcgcttctcatcttccaagacggtattcaagttattcgccaattgcgcataattccaatccatcatccccgttagtagataatcgatttgtgctagtcgctcttcttcatcgtgaatgtatggctcaagttgccaatcaccccaatcgcgaactgcttggattgtccattgttcatcaaacattgtgtcttatccttgcttcaattcttccaacttggccgtttggtcagcgataatcaaggcgtcgataatgtcgcccaattcaccgttcatgatacggtccaacttgttcaatgacaaaccaatacggtggtccgtcacacggttttgtgggtagttgtacgtacggatacgttctgaacgatcaccagtaccaacggccgtcttacgttgctcagcatactcagcttcgttttgtgaagcgtagtagtcgtagacacgagccttcaagatttccatggccttcgcacggttttgttgctgtgaacgttggtcttgcatggcaaccacgatacccgtaggcaagtgggtcatacgaacggctgatgacgtcttgttgacgtgctgtccaccggcacctgatgaacggtaaacatcgacacgcaaatccttgtcttcgatttcaatgtcaacatcttcgtattcaggcatgacaccaactgtcgccgttgacgtgtgcacacgaccagctgattcagtatcaggcacacgttgcacacggtgcgcaccgttttcaaacttcaactttgagtaaacgttgttaccagtaatcatcaaaacgatttccttgtaaccaccgatttcagtcttgttctcatcgatgacttcaacgttccagccttgcttttcagcatagcgtgcgtacatatcgtacaagtcaccagcaaacaaagcagcttcgtcaccaccagcagcaccgtggatttccatgatgatgttcttgtcgtcgttagggtccttaggcaaaagcaagatcttcaacttctcttcaatctcttccttctcgcccttcaactccttcaactcttccttagccatctcttccaattcagcgtcgccaagtccctcgttcaacatctcttcgttaccttcgatgccttcgacaacttccttgtaacgcttgaacgtctcaacggtttcacgcaagctaccttcttccttagaaagcgccatgaaacgttgtgtatctgaaatgacatcagggtcagaaatcaattcgctgatttcatcataacggtcaacaaccgcttggaccttctcaaaaatctcatccatgttgattcaaattccttttcttaaatatgtattagttctttgccatacgacgtgcaatagcagccatatcagggtggttgtagtggtaacggcataccggcatgtaggcttcatccccaccaatttggacttgtgcaccttcgtaaactggttgtccatcagaaatacgcaaattcatcgttgccttgcgaccgcagaatgaacaaagcgtcttcatttcctcaatcttgtcagcataaatcaatagcgcttctgaacctgggaacaagttattgaaggcatcgttcttcaacccaaaagccagcaccggaatgttcaagtcatcaacgacttgcgtcaactcaagcacttgctccttggtcataaattgggcctcgtcaatcaagaccgctgcgacatcgtcttgttgatcttgaatcaacttgaacaagtcatccgcatcactgattgccaacgctgaacgttgcatcccaatacgtgatgcaatttcaccaacccctgaacggttgtctaaggcacttgttagtagcaacacgtgacgttgttgcgtttcatagttgtgagcgaccttcaaaatctcaatactttttccgctcgccattgcaccgtatctaaaaaacagttgcgccatgtgttgccaccttccttctgccaaatttaaaattagttagtttgacactcatttaacagtataacgaaatttcgcctataaaaaaagaagagaactcgcaacagttctcttcttgaagtttagttggctagattcttgtagctcaaaatcttttggtacatcgtcttatactcagcgttcgtcatcgtggccttgtatggtggaatgtagaaaatcttggcgtgcttatcaaggtagtccattgggttcgtcttagcagaatccatggccttcttccacgtatcacgtgagatgccttgcttgtcagcttgccagtcgaggacaaacgatgccaaagccccaacattgtacgtttcagcgtatgcaccactgtctagataagccaaacggttttgcttaaacaacgtccgcactgccgcatcattttgcttcatcgtcttcaccttatctgggtacccagcgaatagtgatgaacgaatctcatagtagtaagccgttccttccatacgatcgtcctcgaaggttgccttgtagtccttctcgtaattttgcttgtagtaacggtacgttgccaatgcttgcgccaatgacttctcagacttattcgtgtaagccgccatcaattgttcttgcaattgcaaacgaatacgacgcgcatcagtgtgcttcatgtactcattttgctctgcattgtagtgcttctttggtgaagcccaaccttcttgttccgttgcgtggaacatttcgtgtgcgtatgtgataaacaaatcgtaggttcccaagtgtgggtaacgtaccaaacgcttcgtgtcgtgcaactcctcattcgtgacagccatgaatgcacctgacttgccgtgcgcattaaacgccatgaaccaacctgatattggttgtgggtaaatgtcataactaagcgcttccttcttagtcatgtctgacacctcaccagtcggcgttaccatccagaacttcttatcatcaacaccattgacaatggcatattgattaacattcttgttctttggccaaagtgatggcgcaatcttatggtataccttcacttgattagcaaatgtcttgtgaacgtatgtgtcgacgtctttatcagcacgtacatctgtaatgccaaactcagtgccagctgcattggcatgggcggtcattagccccaagccagcaacggctgcaatcgctcccaaaacgattgctgatttcttgaactccatcgtacagtcccaccttcaactttttgtttttaattaatacaaacagtttacaaaaagtttgcagaattgtcttttaataagtctgcttaataccgaaacgttctttaatctgagcagtcgtgtacgttggcttgccattattttctttttctcgtaatgctagttccgccataaagcgggcaatatctttttcgcgttgtgtcatgattcccccctcttgttttggcgtgtcgtcgcttgcaagccaggtatgatggccagtttataatttgctcatcatttgttatttatattaatccactcggtcactaggaagtgataaaaatgcaggcctagttttcaactaatagctcacttagaaatttctgtattatccgtaaattcaatccttctaacaatgattcgtccttcaagttgtaacttatgtagcaaattccgaccatgtgcttcattatccagggtctgcccatagcggttaattaacacgctcactctattgaatgtctccatctgcacttgtttctcagtgacgccaggatacagcgagtaatagaagattagtgtaatatcgccaccatacagattggcctcatcaaaaagcgacatgaagtatgaatagtcctggacgcctaatgactgtccgtagaatttaagcactttaaagttctgaacgtcgagtttcacacggttcggtgtagcaaacatcaatgtacgataagtcttgctaaacggcaataatttagcatctagcatttcatcagtctcgcccttttggatatggaaagaatcgataccaaacacaatatcccccgcgtctaagttgccgtgcaccgagagcgcatgactacgtggcgtctcatatgaatcagttttccatgttttcattgtgtagttaaaattcataacgtacgtcgactgcttgtcagcaagtgggacgagatcctcaagcaatttatcaaactgtgcctgagcagcttcaacatatgcctcttttttgtcttcaactgcgccatccaagtgctttttgaaatcagattcaaataaatgcaactcgtctaggtaaattgtggtcatatgtccaaaatcatattgttgaaattcatacaaaggcacaaggcttgtacccgaatagaaaacatcaatgcctgcctgttcaagcgcttcagagaacacattagagtatcgtgcactgacaatattataaatatgtctagacaaccttaatattccttcagcttctctttcagttaaatcatatgcggaagaaattttctctgcattcaaagttgtctcacctgagctgttcaacccgatttggcgcaaacgaatatacatcataattgaagttacaatcttttcatgtgtcgtcaagaaagcatacatcacattttcaacatctcgccatgacgcatcatccgatgaaaatgtttgattcctgcgcaatgtgcaaaaatctcatcccaagctgtatttaaatactcacccgcattaatcatcccctggcgagaatcaaaaaaatctttaaatcccgaagccaaccctgccgccatgtcaaacccatttcccaaaataagcaactgcggatttgaagtatccacctgcatacattccaccttccctagatccattcaacaaaacataagctatgtatctcatctcagatacacaacccactgcttcttctcaacgacacaatttagtgattaattagcatacgctattttcttctacgaggctccctgttccttttttactaaatagtaaaattatatcgcacattcatattttttagatatcaattaaaagccagcattacagtggctgtttatatgagattacatcgcccacaatcagactaacaaaaggccttattcacccaaaacaaacaaatacatcctcgtaagaaaaaacacccatcacaagatgagtgtttagaattcttatatttagaatgattctggctcgatgttggccatcttttctgcccagttcacttcagggtacttgcgctccaatgccgtttgcaaaacgtgcaaagccaagtttccgttacgcgtgaagataggtccgtggaagtacgtaccgtaaacattgcggtaaaccaaaccttcaccaccgtcttcaccgttgtttcccttaccttgaagaaccatacccaaaggacgctctccctcacctaggaacgtacgtccttggtggttttcgaaaccgcggtattcgttaccgttaacttcgtccttgatcaacacattaccgataaaacggctgtgttgttggttcaacgtgtagtgatccataactgagataccttcaacacgcgtaccatcagccatcaagaagtagtgacccaacaattggaagccaccgcaaacacccaacaaaggtccatcagattcgatgtaacgcttgatggcatctgccttaaacttcaaatcttccgcaacgatttgctcttcgtagtcttgaccaccaccgaacaaaacgaagtcgtacttcttatcatcaaactcgtcgcccaatgaaatcaattgaacatctacgtcgacaccgatttgtgaagcgtaataacgcatcgccacgatgtttccgtagtcaccgtaagtgttcatcaaatcaccgtacaagtgtgcggtgtgcaaaacgtattctgctgccatgttccttattctcccataccagtcttgatgaagccttcttgtgccaattgagcacgcaattgcaacatcgcagtgtaggttgccgcaatgtaaacacgctcagttggcatgctgtcgattgctttaacaatttgcttgaggtcttggtagaccggaagatcaccgtaaccagccatcttcaaacggacgtacaagtccttataacgttcaccaccagtgacaatcttttgcataccagaatcttgcaaagactcgaaatcagtatcccaaatccagcttgtgtcgataccgtcagcatagttggcgttcaacaaagtaatcaatgagaatggttgatcatctgtcttcatcatgtcgataacttggttcgcacccactgggttcttaatcaagacaatcgtcacttccttgccgttcaccttaaccgcttcttggcgaccaaagatttgggcgtttgattcgaaggcgtggtgaatttgttccgtagaaacacctaggtaacgaccaacagcataagctgccaaagcgttgtagatgttgtacatcccaccaatttcgatttggtacgtctcgccatcgatatcaaagtttgagaaacgtggcgtcatctcgttaaccttcgttacggcataatccaactctggacgcttgaaatcatcggtaactgagaagtagtcaccttggtttccgaacgtcataaagtgatagtgtagcaccgtatcgtcagttggtgacaaaataccgtcagtattgtgtggtgccttcatgtcaccatcagctggcaagtggttgaaaccaaagtaaacctttggatttggcaagttaccacgcataaagattggtgaatctgcgttggcgataaccgttgcctcagggaacaaacggattcccttcaaaatcttgtcgtaggtcgtgtaaatttcaccgaatcggtccaattggtcacggaagatgtttgtcaaaacaaacgccttaggcttcaattgacgcgcaacggcttccacgttggcttcatcaacttccaaaagtgcgattgggcgttgtgacttgtcagtcaccttggccgtcaacatcgttcccgtgattccttgcatcatgtttgaacctgatgggttcgtgataacgtcagggtacttctcacgcaaaacgcgggtcgtcaaagttgtcgtcaacgtctttccgttagtccctgtaatcaaaataacgtcgtagtgttctgccaacgtcgtcataacttcaggatcaatcttcgttgccaactttcctggcaatgatgtaccgccacgacgcaaaatgtcgtgcaataccacgtatgaacttttaccaacaaaagttgccaatgcactcttaaagctcatgtcgtcctcctactgcatcgttaaacgatgtttatctgtcaaattaactaacttacagtttaccattctcccgcataaaaagttagggtaataggtaaacacgcgaaactttatagtacgcaattttggacttactttcaatagggcaaacaaataggccagccgacgtcgatgcgtcagctggcctattaggtttaattaacgtgattccaagtgccgtttgatccagttgtgaattggacgagcgcgcccaagtatgaaatttgcagaattaacgcatataacaattccggaataatcaggaacgcaaataatctggctttccagccgacgtgccacactgacaccacgcgttcgatgatgaagataatcccaatcaccgcccagaatggcgataggaacaagccgaattcagcaaacaaaatcgtttgcaaaaccaaaaatcctaaaaaggctgcaatcgaaattgacaacataatctgttggaaaatgtagggttgcattgttttgttaggcttgcgtgaaaagacctgttgcagcgcacctaaataccagcggcgacgttgcaaatacaaaagtcgcacagacggcatcgtttcggtatagcagcggcatgatgctggtgaaatcaacttcgcaccgacatccttcaaatccaacgtcattgtgaagtcttctgtgattgactctgggttataaaaatatcccttctcatcgtagatcgccttcaactttgacccgcgaatcaatgacgcggttcccgtcaacacaaagaccttttgcttatacaaaatttctttgcagtagcgctcccattcaagtgattggcagtacttcaaaaagccccggttatcatcggcgcgaaaaaatgatccaaccgcatcgtatttgccactcgcaattaatgggcgtgcacaggcaacccaaccctccgcaatttgggtgtccgcatcacagatgaagaccatcaaatttggaatcgaaaaatcgacatattgtgataacgcttgattaagcgccccggctttgcgcgcggtgttattaaccgtatcaaaagcggtcgcccctatatttagggcaaccgcttttgtgttgtctgtacaattgtcgcaggccacaatcacttcgtctacttgattcaagaggctgtctaccgtcgccccaattaatgcgccttcgttgtgagctggcacaaccgccacaacgcgcatcttttcatcacctgccatgcctgactacttccaatcttcgtcttcgacaagcttaacagtcaacatacgaacgactgcgattgccgctagcattgcaaaaaacaataccaatgcagactcgacgctaacgaattgttgaaactcaacgcacacaccagcaccagctacggttgctgacttaaaacaatgtcccaaatacataccaacagttccttcctgtaattcgatttattttcctttaataagaaaaacatactgccagtatggttttgtgttttaaattgcatttcggatacgctgcgcgcaaaaaaagaccggatttttccggcctttaaaatttatttcgatagtggtcctggtgtagacacaataagggttgcgtcaccttgcaatgtccacgcctcaatgtcatgtggcaagatgaaactcttccccttttcaaggtgatacgtcaccccgaaaacagtcatgtcgaactcaccatcaatcaccgtacccaacagatagggatcacgggcatccaacgtcgcacgtccatccaatgtccacttataaacattgaagtatggtgcttcgaccaacgttgtgacgttcaagccagcatattgggctgacttacgttccggttgctcgggtacaaatggtaccgtcgtcacatttttcgcatcagctaaatgcaactcacgcaattcaccagtcttagcatccacgcggtcaaaatcataaacgcgatacgtcacgtccgatgattgttgcgtttcaagcgctagcaccccggcacccaaagcgtgaagcgtcccggctggcacgtaaaaaaaatcgcccgccttaaccggcaccttgcgtaacaaattatcccagtcacccgcatcaacagcagcatcgaattctgccttcgtttgcgcattgtgaccgtagtaaatctcagcacctggctcagcagccacaatgtaccaagattccgttttccccaattcgccggcatgctccccagcataatcatcatctgggtgcacttgcactgacaaatcttggtgcgcatccaacagctttactagcagtggaaacggcttgtcaggattcgtgttgccaaacaactgtggttcctcgcgccacaattcagccaccgtcttcccagcaaatctaccattttcacagaacacattcccattcttgtgtcccgaaattaaccaagcttcacccgtggtctctgatggaatatcaaagccaaaaacgtcacgtagcgcagtgccaccccacatcttttcgtgcaatgctggttgcaaaatcaatggttcagtcataataaatctcccccgaaatgtacatgaaactatctatttaattgttgaagtgtaggtaaatacctgacaaccaaccgtgttgagccacgtgataccaaacgacaccagatggatcatccacgcgttctgtgatatccaccacagcgccgtgaacaacgcgaccaatttcgcgtccgtatggttgcgcatacactgccacatccccacccggcaggtaatcaatcgttgcacgcgccacaaatggctttggtgcccacgttgttggtcggttccattcagaaaccggcttcgtcgtacggccatcgttatccgttagcttcatcgtttgcatgtcataagccacccaacgcgaatcggccaattgataccagaacttaccgtcacgcgtcgcgacgcgttccacaaccttcatgtatgaatctgcccaaagcttttggccaagtggcgtcgttgattcaatttcatcaactggttgcacgctcgctagcatgcgtaggtacttcccatggattttttcagtttccgcaatgtcagcacggcggtaatagaacgtgaccgtgtgcatcgtcttctcatcaaacgtccctgttagcgttccttctgatgagacaaagcgatatcctgcaacatccgctggatcaagcgagaagtgctccccaaccgttccctcgaccaaacgcgatggcgcaatagatgcttttgaatcagcatccttgctatatacccaaacgggcatgccttgtaattcaaagtcagccatctttgctgcctcctagttgtagtttcttacgtctattctaacagggaaagcatgtaaccgcctacatgactgtctttgcttaatgttttgtttaggtgtcaaaattgttcataaacgaacattaaattattctcatttaactagttgacttctcataaaccatccagtatattatatacataccttagcaaaaggaataaatgctctgtagttcagcggtagaataactcactgttaatgaggaggtcgctggttcgatcccagccagagcagttgccaattatccagttggcaaacatttgaacatcattgctctgtagttcagaggtagaataattcactgttaatgaagaggtcgctggttcgatcccagccagagcagtcatagaaaactcgaaaccctgtcatatcaaggcttaacgcctgtatggcggggtttttagcaccaattcccccaattactccccctttttcttggcactgatttgtaccaattggcatcaaactgggggagtaaaagggggagtaaaatttaatacgagcaaccaactctatccaagccagtttctaaatattgaaacggcttttttatttgtttttttaactcaccacatcgggtttatactcgcataataacgttaaacctgtgactttctcacaattagttgactttctcaagtgaatactactcactacacaacattaaatcaagttataacaacgacccgattggcaaatcaccgataaatctatgttttatcaagtctttaaaaagaccccccgcccctacttcacaaaaagaaaagcacacacattactgtgttcttgtagaaaagtttgattttgaaaaatttttaataggggggtaacggtgttttggactgaaataagaggcatcataactcaatttttgttgtttaacagaagttaaacgaattcactagcgaattgacttcgcaaatgtttttgcatcaagaactagcttgatgaccctacacatttgtttcatcgaaacgatattcagttttcaaagaactatctcggagttgctcatcagcaacgttttataccttaccaactcatgaagcagatgtcaacaacttatttcaaattatttaaacaactcattcacagtttgaacatattttccgtcgcaagcaacttatatatcatatcgaattgatttatgattgtcaacaatcaatttcaattcattttgcatcgttttgcattcgaattagattcgtttgaaaaactcaacttgaatataataccgaacatctataacaaatgcaagccccaatttaatccaatcgtgcaacaccggtcatgtcgacatttcgaagtagctcagcggcatccttcgcattcataaactgcaaacctagcatgcctagttgatccatattgaagcgtgcggcatcgactggttcgaatgtatacaatgaaatcaagtcttctgctgtttcaagcccttgaccgtgccaagctgctaactctcctaagcgaaggttatcaatatcaaaaccaagttcatccttcatccccgttagcaatgatcccaacgcggtgtctccgtcatgcttgtgcatcttaacagtatagaagcgtggcgttgggacttcatctgtgaccaagaagtatgattgatcatttcgagtaaagacaactgttcctgcgattaatgacataatgccatccccctttaattagtgaacgtgtgcgttcaaacgttgcaatgcttccgcaatcatatcatcacgattatcagcaatcgtttcgaacccgatatttaaatgctgattagtccaataatgatggtgccaattatcgacacgttgattttcacggtccgttctaaccttttgattagcatctaatacactacgacgtgacaatgaaatcttctcattgtactggtcgatatctagaatcatgacgtcaatcacctggccaacgtgcaattcatccccaacgtgtcgaataaatgccgagcgacactccgaaatatgtattaatccctgcgtgtgatcatcaagctgtacaaaagcaccgtatggttgaatgccagtcacggttccttgcacaatctcaccaatatgataagccataataacctcctccaattagtttttcttattatatgtatctcgggtttaccccgagtgacaaccttatgcaattgttgccttgataatcttgatatcttcaagtggcttgtctgcgtagttaacacgaaccttagccatgtcgtcaacaacatccataccttcgataacgtgaccgaatacagtgtggcgcttgtctagccatggtgtaccaccttgctcaccgtatgctgatacaacttcatcaggtacaagcccctttagttgacgcaacatgttcgctggtacacgtgaagcttgcacaataaagaattgtgaaccgtttgtgtttggaccagcattcgccatagacaaggcaccacgcaagttaaagacttcatctgagaattcatcttcaaaagaatcaccccaaagtgactcaccacccataccagttccagtagggtcaccaccttgaatcatgaagtcactaatgacacggtggaagataataccatcgtagtatcccttttcaatcaatccaacaaaattctctaccgtctttggcgcttgggctgggaataattgaatcttaaccgtaccctttgttgtttccaaaacagcaactgggccttctactgcagccaaatcaaattgtggcaatgccatatcttcattctcctctaaatcttaaaattcactgcttgtattataacataaacattaaggccactcacactgccccaaaaacatggtaaactagaatctagttgtcaacagacattcaaacagattactgggagtaaacaaatattatgatgcacattatcgatttgttcctgcaccttgatgttcatttgaacaatctggttaacgcatggggcatttggtcatacgtcgcgcttttcgctgtcatcttcattgaaacgggatcggttatcttcccattccttcctggagattcactattatttgcagccggatcaatttcagctttgcatggtagtatccttaaccactgggtactcatgatcatgttctggattgccgctgtatctggtgactcactgaacttcttcttgggtcgcacggttggcttgaagttagttaagcacccactacttggtcgcttcattaaggacgagcacttggcggaagcaaatgatttcttcgttaagcacggtaagatggccgttattttgggtcgtttcttgccaatcattcgtactttggtgccatttacagctgctatttcaggtttcaagtacaagaacttcttgatgcttgaagtcatcgctgcaacaatttgggtcgttgtcgccgttgaagccggttactacttcggcggtatcccatttgttagcgaacacttctcattggttattattggtatcttggtggtaacggccttgcctgctatcatcagtgcagttcgccaatcaattatcagcaagaagcaaaagcaaatgaatcaatgattctaaaaagtcgcgattggtttcgcggctttttttgtacccgtatgtgcaaaaaaagaccatccaacttgtggatggtctttttaactataattagtcagccaagtgctcggcttccaacttagtagcttcttcgtcgataacaacgttaccggcttcaatttcttcaaaagcttggccgattggcttaactgaatcaaagtgagccaacgttggcaatgcaccttgctccaattcgtgggcgcgcttagctcccaaggcaatcaacttgtaacgtgagtcaacacgttccaacaacttatcaactgatgggtataaaatcatgattctagctcctcaatcattgcaatatattctggcaacacacggttaacgcgcaaacgttcaaccttgataatatccttaatacggtcaaccgccaaaggcacttcgtcattaacgacagcataatcataattagccatcatacgaatttcagcagttgcagcagagacacgacggtcgataacttccatcgcttcggtaccgcgaccaatcaaacgttccttcagtgcaccaagatcaggtggcgtcaagaagatgtatgcaccttctggcatcttttccttcacttgcaaagcaccttggacatcgatttccagtaggacgtcgcgaccggctgccaaagtcttttcaataaagctctttggcgtaccgtagtagtttcccacatactcggcgtactctaacataccgtcgttggcaatttctgcctcaaactcttcacgagttacgaagaaataatcctctccgtctacttcacctgctcgggagtgtcgtgtggtcattgagattgaatattgaaagtcgatgtctgtctcttcaaacaacgcctttcgcacagtccctttaccaacacctgacggacccgatagtacgatcaatacgccacgcttcatggtactcttactcctatctttttctctagctaatcaattttatattctactcgttttttccgacttagacaacaagaacaacacggcacttaggacaacatccaaattagccaacatatacgttcgactaatcgtgccagtcggcattggtagcatatcacgtttttctttaccagccgtaacaatggcctcaataaaggtcgttaaatcatactcggctagcttatcaacatctagcaatcttgctaaacgttcaatcgtcgccagtccctgaccagctgccgtctccttttgttccggatcagcatcgcgacgaatccattgttgccaggccaaccaaactggtaggtccgtcaaaagcgctgcaatcggtgctgtcacagggtcagtcgccaaccacttcactaactgactaccacccaaccaactaaaattaacatcagctggcaaagcaaaatagtagccacccagttcaccaagcacttggcgtgttctgatttcaccaagacgcacataggtggcactcaagtcagggaaaaagtctagcaatggtccgaactgccacggcgttcgaatgaagtgaaccactgcatcctctgggcgctcccagttttcaggtaccccatccataattgataccgcataaatttcctttgcaccatgatcagctgcaagattaattggcaaattattcgaatagccaccatcgatgtattgcttccctttaatcatcactggggacacaactgggtaaaacgcactcgatgctagaatccaatcggtcaattcgtcagccgtggtttcatccgtcacactatacggtgcagcctttagcaacgggaattccgtggctaccagcgtcatttctgctaaccttggtgtggctaactcatggacaacaaccggataaatcaattcgcgtaatgattctttgttgaaatagtgtcgaccaactaagtgcgtcgcgattgtcttcgtaaagtcagttctagaaacaccgacttcatccacctcatacacaacatccgtcgtcagcgtgtcccaagtatggtgtgagatatcactattcaaatgcataaatgacatggcattgattgaccctaccgaaacacccaacacctcttgtggcacaatgccgcgtgcttttagcacatagaatacacccgcttcaaatgcaccgtgtgccccaccaccaccaagtaccaaggcaactggatatgcaaaatcatgccgatacgttaactcagccactcggttaaagccagctaacaacgggctatttgtctgatttggcgctacctttatggttagtgatttcacgcgttgcttactaaaataggtgattaactgttcaaacaacgccaaacggtcgattgctttccaacccagggcactaattagtgtcacatccccatcttgttcacgataaaccaccgcagcttcaatcgcatcatcatctgtcacaaataacaagccctgtgcatcagcgcttgtcgcattgtatctgtcacgagcctcagctgcatcagcatacatatttagcagttgtccaaatggcgcaacttgttgtggtgttaatttacccactactatcggcatatcatcaccctcactctcaaaataatcgtatctttattctagacactttatgtcagcatgcaagttttgcgtttaaaaaaaccaggacccaaaagtcctggttaatggttctattcacttcgcttagcaaccgctcgttgaatcaaatcacgggcattttctttggctgcatcggttaattcatccccagacaacattctggcaacttcgttaacacgttcatcctctgaaagtgtgtgaatacttgtctcagtacgatcaccaaccacttgcttttcaataaagtaatggttatcagcgactgccgctacttgcggtaagtgtgtaattgttaatacttgtgaataacggccaatcactgcaatcttttcagcaatggcttgcgcaacacggccagacaccccggtatcaacctcatcaaaaataattgacgtaataccttgttcgcgtgaaaagatcgtcttcatcgcgagcatcattctcgaaagctcaccaccagaggcgattttaaccaacggcttagcaccttcacccgggtttgtttgaatataaaattcaactgcgtctaatcctgtggcattaagttctttcagttctgtgatgtgcgctgagaaaactgccttctccatgtacaaatcacttaattgttcatgaatcttcgtcgctagctgcttggctgccttaagtcgtagctcatgaagtttctcagctagtgtacgggccttttgctcagcgacttcaacttgctcagctagttcagctgctgattgttcaccaccgcccatttcagccaattcagcatcaactttcgcttggtgcgccaatacgtcggtaatagttgcgccgtacttacgttccaatgagcgaatcaagttcaaacgatcatccacttcgcgtaggcgttcttcatcaaattccaaaccatcccgtactgacaaaatttcagacgctgcttccttcagttcgtaatacgcaccgcgtactgcctcagttaacgttgcatacttaggtgacaactcctcgatatcttccatcgcgctcatagcagtagaaatggtctctagaccgttgttatcccaatcgccgtccaacgcttcatgcgccttagaaagggctgccaaaacgtcttggaagttggtgagttcttgatactcagcttccaacatctcttcttcgccttcaaccaaactagcatccgccaattccttgctctgaaaactcagcatatcaagccgttgcgcccacgcttgttcgtcagcctgacgcttatggaaggcactttccagactacgataggtatcgtacgctacacgatacttctctagcaccggtccgatggtcttcttcccgtactcatccagtaatgataaatggcgctcaacttgcatcaactcttggtgttcgttctggccatgaatatcaaccaggtgctgaccaatttccttaagtgtcgtcgcattgactaaactaccgttaacacgaatgacattacgaccacttttatgcaattcacgatgaattaataattggttatcttctagcgggattcccaactcatcaagtaattgtgtaatcggttggcccggctccacatcaattaagccctgcaagaccgctttatcagcaccctcacgaatgaaatcttgtgaaccacgaccgccggtcaataggccaacggcatcaataataattgactttccagcaccggtttcaccggtcaaaaccgtcatccccggttggaagctaatgttgagctttggaataatcgcaaaattttgaattgataattcttgtagcatagcctgctcctcttccgttaactaagcttgcgccgtcaacttatttgcaaagtcctttgcaagctcaccctcacgtaagattaccaaaacaccggcatcgtcaccaatcagtccaaagacttctggcaaattagcttcttctaaggccgtcttcagagctggaccagtaccaggtgctactttgatcataatcatgttaccttgcgttgcgacatcggtcgtcgtctcttgcaaaatgcgacccaactgaccaaagtaatccgcccctgacataacagcgtaggcaaagccaccagtaggtagcggtaccttcactaattgcatttccgtaatatcacgtgagattgttgcttgcgtaacctcccaaccagcttcattcaatttacgtaccaagtcttcttggcgttgaatttgctcgttgctaatcaacgtcttaatggcttgttgacgttcttgcttacttcgtctcatccgtcttttcctcacgacgtgcattcaattgtgcgtgtgcactagccactacggcttcacgttcagcttcagacatcgtactatcaccaccatcaagaaccaagtgcgccaagaactcaatgtttcctgaaccacccttgattggtgaatagtccaacccgacaatactgaaaccagctgcctttgcatagccagccactttatcaataactgctaggtgtgttgcagcatccttaacgatgccgtgcttcccaatcgcttcacgaccggcctcaaattgcggcttaatcaacgttgccactgaaccacctggcgtcaaaatctttgagagtggtggcaaaatcaagttcaatgaaatgaatgacacatcaatcgttgccacttcaggttgtccttgcgtgaaatcttgcaattctgaataacggaagttggtgttttccatcaccacgacacggtcatctgaacgcaatttccaagccaattggtttgttcccacatccagtgcgtaaaccaacttagccccgttttgcaatgacacatcggtaaatccacctgttgatgacccaatatccaagacagtcttgccatcaactgagatatcaaacacatccaaggccttctcaagcttaaagccaccgcgtgatacatatggcattggtgcgcccttcaagtgtagctcagtcgttaccggaatcttttcgcccgccttatccatgcgttgctcgttttctcccaagatttcaccagccataattgctcgcttggcttgttcacgtgaggtaaataacccttgttgaacagccaaaacgtctactcgttctttctcaatcgccattatttctccaatgtctcgttaaagtaatccaaaaatgataccaacagtgtaatgtcgttacctgtcaattcaccaaacttttgcaatgcctgattagcaaggttaacttgctcacgcaatgcatcaaccgcgccttgtacaccaagcaacgttggatatgcttgcttgtcctcatcatcatcctgaccaaggtcatccaaatcatccttaatctggaaagcaagtccatacgccatgccgaagttccaaagttgttctttgaccgcttctgatgcatgagccataataccaccggcaatagcagcataagcaatcaacgcactggtcttgcgatagtgaatagccttcgcttgatcaagcgtaatcgtatcagcattcgtcgctgccatatccatcacttggccagccaccataccgttggcacctgatgccaaagctaattgtagggttagctccgccttttgtggcgttgttaatagcggatcactagctagccattgataagccaacggttgcaaagcatcccctgccaaaatcgccacatcttcgccgaattgtcggtgagtcgttggcttgccacggcgcatatcgtcattatccattgcaggcaagtcatcatgaattaagctgtacgtgtggattaactccaatgcacttgcagcacggaccaaccccggtacacccataccgtaagattgtgccaccgccaatgtcaacaatggacgcaatcgcttaccaccagccattacagcataagtcatggcatcacgtagtgtcttttccgttgtactttgcttcaattcggttgccaaagtctcttcaatctttgggacaacttcactggcaaactctgttaaattcatactacgcctcgggattaaaatctgaggttgaaccatccgcattaacaatctttgccaagctttgttcagccgtttgtagtgtcttttgtagttcctgactcaactttacgccagtctcaaactccttcaacgcttcttccaaaggcacatcacccttttccaagcgggcaacgatttgttccagcgttgccaagttttcttcaaatgttttttctgccattattctgtttcttctttcttcgttaccgtcgctgtcacttgaccatctgccaatcgaatcagaacatcttcttgcaatgtcacatccgccaccgaatttaggatatggccatcctgttcaacaacgctatagccacgagccaaaatggccagcgggctaactaattgcaaccctgcaacggctttaccgactcgttgttcggcattttcagtttgacgggtcatggcatttgttaaacgtggtgcaatcaaatcaaattggtgacgtcgttgcgttaccaaagtcacaacggattgttggagtcgctgctgcgcaatgtctaaacgttgtaagtacccctcatagaggcgagccggttgtgtcaaaacataactgttttgcaaccgttgcaaccgttcttgtgaattaacgacttgtcgttgcatttggttaaccaaccgttgttgcatttgctgaatgcccaaccacaagtctgctaatggaactggcgtggccaattcggcagcagctgttggcgttgccgcgcgttgatccgcaatgaaatcagcaatcgtcgtatccgtttcgtgaccaaccgagctgataattggcatcggcatcgtcagcatttgccgtgcgactgcttcctcattaaacgcccacaaatcctcaattgatccaccaccacgtcccataatcaaaacgtcgtagtcgcccgattcagcaaccgccgtcatctgggcagttagtgatggtacagcgccatctccttgcacaaccgccggatagaggacgatttctgcaattggataacgtcgttgcaccgttgtcataatgtcacggatgaccgcaccacttggtgatgtgatgaccgcaattttctttggaaagcgtgggattggacgttgcagttgattaaacaacccttcctcagccaatttcgctttcaattgctcgtaggcctgatacaacgcgccgaccccatccggttccagcttatcaataatcaaactatacgaaccgtttggggcatacaaatccatgtgcccgacagcgttcaccttcatccctggttccaacttgaactgtaacttttggaaggcgaacttgaacatcgttgcgttcaaaacggcaccatcatcttttagtgaaaaatattgatgcccaggacgttggcgataattggaaatttcacccgtcacatagacctcttttagatagggatcggctgtgaatttacgctttaagtacgacgtcaacgccgacactgttaaatagtctgccatgggtcctccaatgcaaccccgtggtgttgtgcggcaagttcaaccgtcgtttgtagcaacgttgcaattgtcattggtccgacaccaccagggaccggcgtaatcaaactagcaaccggttcagctgattcaaaatcgacatcccctactagcgaaccatcttcaaggcggttaataccaacatcaataaccaccgctcctgccttcaattctgatcccttaatcaggccaggaacaccggttgcaacaatgacaatatcagcctcgctcacaagcaattccgtcaacgatgctggcgtgtaacggtgcaatagtgaaacggttgcattggcaccttgtagcaaggcagccattggacggccaaccaaaattgaacggccaatcacaaccacgtgcttacccgccacatcaacaccttcgtgctgtagcatcgtcatgataccgcgtggtgtgttggcaactggatagtacccttcacggttagcatacaaacgaccgatgttctctgggtggaacccatcaacatccttacgtgggtcgatagcttcttgcaccttgtgttcatcaatttgtgatggcactgggctttgcaccaagatagcgtcaacgctatcgtcagcattcaattcagcgattttggctagcacctctgcttctgaagcatctgttgggtacttaattgtctgtgcattcacaccggctttaccagctgcacgttccttattgcgaacgtaaatctcactagctgggtcatccccaaccaaaataacagccaaccccggtgtaatcccttgcgtcgccaacttttcagtttgacgcgcaacggctgcacgtaagtccttggcaatttgcttgccgtcaattaactttcccatggtgcacctcacttttattcattatcaatgcataaattttaccacaatctatgccgttaaaccatgaaccagtccaagcaaaaaacggctgagccctttaaaaataagggttcacccgttttaatatactttaaattcagaaaatcattacccaaaatcaataatgaataaagggtaccgactacttaacaaaccacgtgtggtacaacttaataaacaacgttcctagaatcgcaatgaccaatgtattcgctagcattgccatcccagcttgagcgtacgccttaccaagcatcgtcccataaatccagtgatcaccaagtggtgcaataaccaaccaaacgacagcattcgcaatcagttgccaaatgttgaataacaccagtttacgtgatgtcaattcaccgacgaaaataccaatacgtgtcgttgccagccccataaagaagccaaacataccgtcggcaattgcccaagtccaccaaactgaatccaagcttgccgatgacaagtcagtcaacgaatgtccaatgaatgccacaatgaacccagcaattgggccaaaaatagctgacatcaacgccaaccaagctggtgccaacgtgatatctgtatgtgcaacgcctgaaggccaggcaatatatttaaacagcaccacaaagacaatcgtaccaacaattgtgccaatcaccttgtgtgctgacaaaatattatgattcatggaaccactcctacatctagttttcgttattcatgactgtcattcaagacaaccaagttttgtggcaaatcttgcccgttaagttgctgataatactttcggaaaacggtattatatgaaccctcactcatcaagttggggttcatcgcaagataacgaatcgttttaacttgcataatttctgttttattcggcttactgaagtcgttaataccaaccattggggacatcaaatcatttgcttgcccttggtgtttcaaagccaacgcgtgaccgaactcgtggataattgtatgctcagcttcctggttgtgcaagtcctcaatgtcccttgatgttaccgtcccgtatacggctccagacagatagtcttcacgttgaatcgtcttagctaaccacactttggcagcttgctttgaaatccacatcgtattaccggcttcagtggtcgttgccaaaacagttgtatccgtcttacccagatcatccgtaatatctttgtagccaatcaacaattgataatccgcatcatctggccagacgttacgatcaacattctcgtgttggttagccttagttgacgtgactttaataaagtcgacccctaatgccttattccaaacttcagccgccttgtttacccaaaccaacgcttgaccatctgtttcactcattgccttagacgacacaacgaccttcatctcaccatcagtattcaaatcccaatgcgatgtgaccggtaacttatcagcatcagttgcacccatcgcagcctgttgcttaccgactttagcaatatatgctttctcttgcttagccgccgcattagcatcagccacattcatatagtaacgaataacttgtggtgcaatcaacaccaacaaaataataatcgtcaacacgattgccaatcgcttgttacgactcatccgcttccttcgtgccatatatactctacctcatctcaaaacccaaacctaaaacgctactcgccgtcctctgcctcttcagccggtgcgttcttttgctcttcaattgcctcgttaattgcagtcagttccttatcaaagaaggcagcaatttttgcttctaccgtttctggatcatccaaaaacgctgcgacagttgctgccgtttcaatacgtaggccagactttgtcactaatgggtgttccacaatcatgtaaagggtcacatcagtttccggatcattaatcacaatcttgctaatcgcatttgtgtagcgaattggcaaattaatcagaccggtttccaaacgcaagctaattggctcatccccactgataagcaattctgcactgaaaagcttgttatctgccaacgccttttcagcatatgtaaacaaatcgtccaaattaacagttgcttggtctgccgcggtaaacgacttcacctcatactgttcatccttaatcgctgcaataaaatcatttccagttaattgcatcatatttctcgcttttcattgatatctaacgattagtgtagcataaaacaggccgaggtttgttttcctcggcctgttcttaacttaatctgtaattggcgtaaagacatggtccttcaacaaaagctgttcatcggcctgcttggctacttcacgatcgtgggtaatcaagataacagtcttgccaaattcgtgggctagttcagcaaagagcgaaacaatcttttctgaattttcgtgatccaaatttcccgtcgcttcatcggcagccacaatcggcgcatccactaacaaagcgcggacaattgcgacacgttgttgttcaccaccagataaccgttgcacattcttttgtgccttctcttcgtcgatcccgacgcgggccaattgttccaagatatacgtcttatcatttgcgtgctttgacttcgtaatggccaatgccgtttggacattttgaaacgctgtcatcgtcgtcaatagattgtatgactgaaaaatcgttgagacgtacttctgtcgaaaagcggttaggccaatcttcttgattgaaacaccgtccactaggatatcaccttcacgcgggacatctagccctgccaaaaatgaaagcaacgttgtcttaccagatcctgattcaccgacgatggcataaaacttgccactttcgaaggtcagattaacatccttgtacaacgcattgtccgccgttgtataccaatgcgttaaatttttaatttctagcgtcattattattcctcactaatcggcttgcaaaatttgctttggtcgcatacgcaagatactaaaggcggcccctgataccgaaagcaccgcaatcaagaacgcaacgccgcccaattctgcaattgctgccggcgtcattgcgacatccaactgttcatttttagcagctgcaccgccacccatcattgggccaccgcccatgccgccactaggcttgcctgatggcgcaccaccttgttgcccgttttggccactacctggcatgccaccacgcgctgattgcatttgttgggtcgtttgttgttgtacaagttgcttaccaactaagccagaaacactattaccggctgctgttgcaatacctagcgcaattgccaaaataaccagcatttccgtgaacaattgggcaacaacctttggcttagactcaccaattgataccaagataccaatttcacggcgtcgctcgcgggtaatcaaaataataatcaaaccaagaatcaagacaccggcaattgacacaatccaaacaatcttagaggcaaatgctgccacgttcttcatacttgcagccaccgtcttgtattgacttgcatcagacgtcaaagtaagttctgacgtatcaatcaacttcttggcttgcttcacaaacgctgttgttttagcaggttcagccatcgtgaacgtcacgtttgatgcttgatctggcgtaccattaatatcattagccaatgtgaacgatccataaattgtgttagccggatcttcccgttggaatccgtcggtcgttgtcttcaacttgtaaatgccgacaaccttaacggtcttttcagtcgccgcatcatccgttgtcttaacagtcaacgtatcgccaaccttaatgttgttagccgtggccaattcatttgcaatcacaacattattggtgttttggtcactcgtcttaatgccacgacccgatacgattttggctgtgccatcagaaaatgaagccgttgacgtggttgacgtcacaccattgatttgaatgtcacctgaattttgattacccatcatgccaccacgatcaccaccacccatcggcgtattcgttgatgtggttgtaatcgccttaaaacttgaggcgtttactgaggcactattcgtgatgttgtatgaggcgacgtttgaaagcgccgcaatcttcttaacttctgaaatcgttgccgttggcatcgtaatcgacgtcgttgtgtctgaagatgacgagtcactagaagaagattcggatgattgcgccgccttcatctgctcaaacattttctctcggttagccgacaacgttactgttgatccaactgaattagcggcattcgtggctgcttttagggccgcgttttgtacaatcaacccagccatcacaaacgctaaaataaccgttgatgtgaggactaacaagaccgagcgcccttttcgcgcccacaatgtgatacctgctcgttttacgaaattcatgttacttgtcgctcctatcattgtgtcgttgcgctacttgctgcagcatcatcgattgaatttgactgtgattggttaccataaccgcccatcgggccaccattaccaccaaagcccccagtttgctgggtcatatttggtcgacttgtttcacctaaaccaaacgggtgaaacgctgcaatagcactaaacgccattgctaacgtggcaatgccaagcgtgacgtactgtaaccaaggtcgttgcttcttttgctcataacgatctgtcatatcgctatcctccatctattttttgacaaggcttataatatgagtccaagcttaggcgatacttcacgggggctaaaagcaaacataaatttttatgtttttcgaattgttagtggggatttggggcacaaaaaaacgccgtacgacacaaaatcgtacggcgtttaatttatgcaatctaatgattacttgttaacggcttccttgaagtccttaccagccttgaaggcaggtgcctttgcggctgcgatttcaatttctgcaccagtttgtgggttgcgacccttacgtgctgcacgctcgcgaacttcgaaagttccgaagcctaccaaagcaaccttctcgcccttagcaagttcgttcttgataacgtccaacaatgcgttaactgtcttagcagtttctgactttggcaattcagtttgtgctgcaaccaagtcgatcaattctgtctttgaagccatgtgataatacctctttattaattattacctgattagtatacgctatgcatcgcaaaatacacagctttttgtgcgaaattactaagcggtcttagtgaatttttaaaaatgtatgcaaaatacatacctataaaaagagaatgccgctataactggcaagttacagcggctaagagagagaaagagaattggttgtgtaaagcatctctgctttacgagtattaatataacaccccatgtatacgtttgcaaccaatgcccccgcctattctcctattagtcggatttcctacacaaacggcacaatttcttcacgattggtcaactttgcaccagctgcctcatcgataataactgtgacatttgcatgcttttgcaagatacttgcaggcatgtcttccgtaactggtccttcgatcatcgctgccacagcatcagccttcgctgccccgtaagcaaccaacaaaatttccttatccttcatgatgctaccgattcccattgagtaggcgtagcgaggcacttcgtcttcgtgctcaaagaaacgcgcatttgcttcgattgttgactcagttagcgtcacttcgtgcgtcaaagaatcgaatggcgtaccaggctcgttgaacccgatgtgaccgttttgacccaatcccaagatttgtagatcgattgggtttgcgtcaatgataccttcgtaacgcttcgtctcagtttcagcatccgccataccgtcagggacatagctctccttgaatggcttagcattgaacaagtgctcgttcatgaagtaacggtagctttgctcgtgcgtaccaggcaagcccttgtactcatccaagttgattgaaatcttatctgagaagtccaagtcgctagctttcaactcatcataaattgagattggcgttgaaccagttgccaatccaaaaacgtgtgcgccattcttaacagcctctgcaaagacatcgtatcctgcgcggccaccagcttgttgatctttaacttgtagaatcttcattttatttccccttaaaaaatgcgttctgtgtttttatttatctttggtatagaccaattatagaccaatttctataccaattcaactcagaaagtcatttttttttgtttgaggttttgttagttagttggtggttagtgtcgtcgctatcgcgccgaagcatgggatttggttggggaggcggtgctccgtcctacaatataagctggtggcaacggagtcccattctcactaagcctcagcgtgtttcagcgcctgccggcttgaaacccactgctgctaagtgacaattggtgctcctgtccttgcttggtcaccggctaatatcgcaggagctccgcaccaccaccccaaccaaatcccatgccagcagccaagatatcctagtctgttgtagcttttcatctacgggaaaacaaatattaaacagttcacccttatgccctatgccggatgaaaatcaaaccaatagagtattgcttggctgctgtgacctgccccgccgagcgtatagacccaagtggaccttgacccgtgggtgtgtgttcttagcgggtttcccgcttagagccacgaggaggtaaaggtgtacgctgcaacgcagtggactccgctccccacaggtcatggtccacttgggttagcgagcctacagaaggggcaggttactcggcgcggtagcgacgacacaaaccactacacaaaaagacctgatgtcaggaattccccaacatcaggtctttaatcgttaattattatcccttaacggccttttccaatgtctccattgcgcgtgagtgacgtgcaatatctgacatcaactctgcttcaaaggcatcaacagactttgacttcgtgtccgttgaaccgaagcgacgaatcgtaaccgtgttgttgttaacttcttcatcaccgataaccaacgtgtaaggaaccttagacgtttgggcatcacgaatcaagtaacccaacttttcgttgcgatcttcgtattcggcacggataccttgcttgatcaaacgatcagccaagtccttagcgaacttaccgtgagcatcgcggttaacaggaatgatacgtacttggtgtggtgccaaccaagttgggaacgcacccttgtacatttcagtcaagtaagccgtgaagcgctccatcgtagaaataattccacggtggatcataactggacggtgcaattcaccatctggtccaacgtaagtaacgtcgaaacgctcaggcaacaagaagtccaattggatcgtagacaacgtctcttctccacccaaagcagtcttgatttgaacgtccaactttggtccgtagaacgcagcttcaccttcagcttcgaagtaatccaactccatgtcgtccatggccttcttcaacatcgtttgagccttgtcccacatgtcatcgtcatcgtagtacttttccgtgttttcagggtcacggtatgacaaacggaaacggtaatccgtgatatcaaagtcagcgtaaacgtcgatcatcaagcccaaaatcttcttgaactcgtcttcgatttggtctggcataacgaacgtgtgaccgtcgttcaacgtcatttcacgaacacgtgacaaaccagtcaaagcacctgacttctcgtaacggtgcatcattcccaattcagcaattcggaatggcaactcacggtatgaacgtggcttgtgcttgaacaccatgatgtgagatgggcagttcattggacgcaattccaagaactcgccatcacccatgtccataggtgggaacatgtcatcgcggtagtgatcccagtgacctgattgcttgtacaagttcaagtttgacatgattggcgtgtaaacgtgttggtaaccgtcttgcacttcgcggtcaacaatgtaacgctccaacgtacgacggattgcagcaccgtttggcatccaaacagccaaaccagcaccaacttcttgagacgtgaagaacaagtcttgctctgcaccaatcttacggtggtcacgttccttagcttcttcacgacgcttcatttcagcatccaagtcttcagccgtccagaatgccgttccgtagatacgttgcaacattgggtttgaagactttccacgccagtaagcaccagcaactgacgtcaacttaaagtgcttaatccagttcgttgatggtaccaaaccaccacgatccaattcaacgtgctcaccttgcacagcgattgagatgtgctcatcggctggcaaatcgttaatcaattcaatcttgtatggatcgttcttgaacatctccaaagcttcgtcgcgcgtaatctcacgagaaacgattggcaagttttctgaagcaatttgcttcatcatcttttcaatctcagggaattgctcagctgaaatttggctaccctcaaccttatcagtatcgtagtagaaaccattatcgatggctggaccaacaccgtagtgaatttggtctgggtacaaacggttcaaagcttgtgccaacaagtgagaaacagagtgacgcaacaattgcaatccttctgcatcatccttggtaatcaatgaaaaggcaccatcttcttgaatgccatcgttcataccaacgtagtgaccgttcaacttacctgaaacagacttcttagccaatgactttgaaataccgttagcaatttccaaaggcgttacgccagctgggaattccttcacagcaccgtctgggaatgtaatctttacatctgccatattgtgtaatctcctatttaatctgcgtgcgacttgacgcgcgaaaaacaaaaacgtcccgttacaacaattatacttgtcgtaacgggacgtttgcacgcggtaccacccgaattcgagagggttccccctcacctcatcgtcccttaacgcgggaaacggaactggttcaccagttcgcttggaagtagtaccgttcaacgaccgttattcgcctcccaccaatggcaaactctctaaaaacaatcttgttcaacgacttatcttcgtcaacgctttattcttaacttattatactcgaaaaatcgaaaaatgaaacccttaactattgacgcaacgattagttaacgccttcctcttcgccagggttaaaccatgacgcgtgggcatttgtcttttgcacggttaggtcgaaatagtggacaaccttgtctggtgcattatgccattcccacttcttgtccaaagatgccttcgtaataatacggtattgcgtacttgggaataagcaactaataatggttaatcgtggcgattgtgtttgacgcaatacgtcagtatcacctttgttaaccagaatttggcccgtaaccttatattcataaatgcctgatcgattggccatatagattggctgaccattcaaccaatcactgcccttcaactgaccatcaacaaggtaaggggcatcctgattcaggcgctcctgtaaggcagaaaagccagttttaccatcattaaaattgtggctggccaagccgtaattgccttgccccatgacgggaacctggtcaccatccggatcatctaccgtgcgattagcatagttcgcgccggcatccagaccaacttcactgtatgcattatcgaaaattggttgcaaaatgcctagtagcggcatgctaacgaacccttgcttatgtagtccctcatcgcggtgtgtttccttcatgacccggtcaacaatggcttgtcgttcaggttgcgtgattttctcatttgacaccttaactctttgcttcaattcttctcgttgaatggtgccccggatatttaacgtattttcttgatatccgtaataaccacctgctacgacgccccctaccaagaccgccggcacaacgcgccgtattagcttttccattaggcgtcctcctcaaatgtttagtcattctattctagtgccaaaagtgattgcggacaagttaatcagtggcaaattacttctaaacgaacaaaaagattggcttctgcgagatgccaatctttttttaactttatttgatttagttattgcaacgttacgcccgcttcacgcgctagttgtcgcaattcagaagattccaaatgcaaatccgaacgtagtcgcccaaatgaaattcccggtttgttggcgacacgatcttgaatacgcttgatttggcgctcacgatactcactcttgtgggcactttcgttttcaaccgtcacgctaaactctgatgctgcagacgttgcaaaggtatagttcaattgtccgacccctgttgacattgatgtaaagttagccattaatagccccccaataaacgtacattgacgatgttttctttaagatagttcttattatactctattgttcgtaaaaatgggattatttgttttaattccctaattatcgttcagaaataaagaaagaatccgatgtttcagataacgaaacatcggattctttagttaattatcgtaattcaacgccagcttcacgtgcaagttgacgtaaatcagctgtttccaaattcaaatcagcacgcaaacgtgcgaacgtgatgtcgggcttagttgccacacgatcacgaatacgcttgatttgtgcttcacggtagtggttcggacgaccacttgcattttctacctttacgccaaactcggcggctgttgatgttgaaaatgaatagttcaactttccgacaccagtcgacattgctgaataatctgccataatgtttcccccatatgactatctctaatttagaaatatcatacaagtcatatatggctgaattgtgatttgtttctgaagtctaaagaagcaaatcttgcccgcgaagtcaaatattaaaaccggcagctgtaacgaaacaactgccggttttaatcatcatgtttattatgcgttagccttttcaatcaaagccttcgtaaatgcttgcaactcttcagttgcttcgacatctgggctcaagttaaccttaacaccatcggcacccttagtagcacctgacttctcaaattgtgcttcgaacttgtcgatagcaacggcaaagtccttacagtagaagtcatcaccagaacctgaaacaccgtagacaatacccgtcaaatcagcgtcttccaagtcctcaaagaagtccaatgactcatcaggaaccgttcccttatcaaacgtgtaaggtacaaccaccacgatatcagtctcatcagctgaaatgtcgtgtgggtcaatcattgagatatcttccttcgtaacctcaacaccttctgattcaaacgtgtcgatgataacgtccgcaacatcttcattgttaccagtaattgtagcgtaaaatacacgagccttcatgataatctacctcttttaaaatctgtcatttcgtatttgttgatacaagtatattgcgaatacggaacactttcaaattaaaaggggtggttatcatattcaatccatgattcgtgtgaatcttgaatacgcttaaacatcttttgcatgtccaacgttgagaacgtgaccaagactgggcgtccgtgtgggcagttgtatgggttttctgagtgtgacaattgatcaatcaagcccttggcctcaaagtcattcattgaccagttagccttgatcgaacgcttgcaggccatcataatggcggtacgctcacggaattgcgccgtcgtcaaattaccatcacgcaaaatccaatcaaccatttcacgaatcgtatcttcttcttgccccttctcaaaccagcctgggtgttcacggacaatcaccgcgtcatccccaaacggctccaaatgcaagccaaccttagccaactctgcttcgtgggattgaatcttcaagatatcaatcttagggtattccaatacgattggcactagcaacttctgcatttccatgccgaccttaccaatttcctcacggtagtactcatacttcacacgctcttgagcggcgtgctggtcaatcaagtacaacccttcttcagattgcgcaaacaagaacgtaccgtgcatttgcccgatataatcgagctttgggaacttttgaccgtgctcatcaacagccgtgatggtgtcgtctttcaagtctagtgattcttgctcagccgccatcgtcacgcccccttcatcaaaggggttaactgcatcggcatcttgatacttttcagcgaattcactcaccgccgtgccttccagttcatccgcattatgcaccacaaccggcgcgatatcatcaacggagaagttatccgccaacttttcgtaatcggctgtcgacataggtgctgggtgattggcaggtgtatccggcgcatatgagctaacatatggctttgacgcttcgtttagttgcgccaagaacgcctcgtcattttcagctgcgttttgctcctcgcctagatagttttcataagcatttggaatcaagttctggtttgcaaaacgttccttaactgtacgctcgatcaaatccatcaactggctttccttagaaagacggacttcatgtttttgcgggtgcacattcacatcgaccaacagtggatccatcgtgatttgcaaaaccgcaattgggaaacgaccgaccatcaactttgatccataccccttaacaagcgcacgactcaagttaaagttcttgatataacgtccgttaatcaaaattgaaatgtatgaacgatttgcacgcgtcaattcaggcaatgaaatatacccatttaattcaaagtcgttgtcctcagcctgaattgccaacatcttacgagcttgttgtacaccgtaaatagacgcaatgacctgttgtagattgccgttacctgctgtacgcattacttcgttgccgttgtgtgatagacggaatgaaatatcaggataactcattgccaaacggttaatcacatcgacaatctgtgctaattcagttgattgtgacttcaagtacttcaaacgcgcaggcgtattaaagaacagctctgacacggtaatgtcagttcccttacgtgctcccgttccgacttcttcaagtaactcgccacccttgtagtgcacgcgcgttccttgtggtgcatcagccgtagccgtttctaaaacaacatccgcaactgacgcaattgatggcagagcctcaccacggaagcccaacgagtggacacggaacaaatcattacgtgacgtaatcttagacgtcgcgtggcgcaagaacgccttttgcacctggtcagcctcaataccatcaccgtcgtcaataatgcgaatcgactttacaccagcttcttcaactagcacgtcgatctgatgactattggcatcaattgcattttcaaccaattctttaacaacagatgcaggtcgttcaataacctcaccggccgcaatttggttagctaaaatatctgataattcatgaatttctgccataacgcagccctcttattacttcatttgcttttgccactcatttagtttcatcatcgcatcaagtggcgtcatcgttgcgatgttggtttgcttaatctcatccaaaatggcttgaagggctgggtcaaccgctggctccaacgcaaacaagtcaagttgcgtatcttcttcaacaactggttccggttctggtgcgactggtaatgctaccggttcagccaatttagctgacactggttgcggttgcactaacgtttctgaaatcgtgacatcttgcgcttccaagcttgccaaaatatcagatgcacgggcaatcaatgagtctggcaagccagccaacttcgccacgttaataccgtaactttggtcagccggacccgtcaaaaccttgtgtgaaaagaccaactcaccattttcttccgtcgcaccaacgtggacattgcgcaaatgatcaagctcatctgacaacgccgtcaattcgtgatagtgcgttgagaaaagcgtcttagccttggtattgttgtgaacgtactcaatgattgcttgagccaaagccataccgtcatacgttgccgttccgcgtcccaactcatcaaacaaaatcaatgaacgcttcgtcgcattttgcaaagccgtatttgcttcggccatttcaaccatgaatgttgaatttcccgaaatcaaatcgtcagccgctccaatacgagtaaagatttggtcgaaaattggtagttccgcctcactagcagggacatatgacccgatttgtgccatcacgaccgtcaaggctagttggcgcatgtacgttgacttaccagacatgttcggccccgtaatcaacataatcgtttcgtcttcatccatgtagacgtcgttggcaacgtatgattggtgacccaataccttttcaaccacagggtggcgaccatccttaataaccaacttttggctatcaaccaatgtcggacgcgtgaacttatattgttcagccaccgtagcaagtgattgcaacacgtctaactcagccaacgttgcggccagcttttgaatacgcgcaatgttgtccttaatttggtcacgcacttccgtgaacaattggtattccaaatcgctcgacttcgtttcagcttccagaataatttgctcacgttccttcaactcaggcgtaatgaaacgctccgcattcgccaacgtttgcttacgcgtgtaacggtcagggtcaagcttaccaatgttagccttggtgacttcgatatagtaaccaaagaccttgttgaaaccaatctttaatgtactaataccagtcgcttcacgctctttagcttccaactcagctagccacttcttaccacccttcatcacatcacgatactcatccaaacggctgttgtatcctgagcgaatcacaccaccatcagtaacagaaattggtggttcctcggcaattgcctttgaaatcaaaatttcgatatctgaaaccggatccatgcgacgcagcaagtcaccaaagacagctggatctaaatcaccaagcgtcaccataatatctggtacttggcgcaatgaattacgtaattgcaacaagtcacgaccatttgccgtaccataagcgacacgtccagccaatcgttccaaatcgtaaactgacttcaacgtttcttgcaaagcagcgcgtgagaagaagtccttcaacaattcaccaatcttgtcatagcgggcctcaatggtctcgcgatccagtaacggttgctccaaccattgcttcaatgcacgaccacccatggccgtcttggtattatccaacaaccacaacaacgttcctgaacgctgttgcgtacgcaagttaaccgtcaattccaagttggcacgtgaattacggtctagcttgaggtattgggcgatttcgtaaggcgttgccatctgcaagtggtccagcgagcgcttttgtgtcgtaaacaaataagccaacaaaatatcagccgcttctttttgttctggcacttccaattgttgcgtcaaatatgacgtttccgcattagccggtgcttcttcttgctttgaaaccaagattcctaagctcgtgaggttggccatcaattcatcaggcaactcggcgttcgtgacaatttccttcgtctccaaacggctgatttcattcaatacaccgttcgttgctgaaactgacgtcgccttcacttcaccagttgaaaggtccgcataagccaatccaaaaccaccaaccggcgtcattgataagctgaccaagtagttgttttccttggctgcatccgctgtattacgcatgcgtgttccaggtgtcaccagttggacaacctcacggcgaaccatcccctcagcttcagctgggttttccatctgctcaacaacggcaaccttataacccttatcaaccagaatatcgatatagttttgtgcggcgtggtgaggcacacccgccattggaattggttcagcagaattcttattacgttgcgtcaacgtcaactccaatagttgtgaccctaacaccgcgtcatcattaaacaattcataaaaatcaccgaggcgataaaacaaaaacgcatcagggtattgcgccttgatttcgttatactgtttcatcattggtgtttctttcggcttagccattatgcaaattttccttccccatcaaaatgtgcaaaaacgcccaccggttcagcgccggtaagcgttcattttttaatcttcgtccttgaacaaatctgccaagccagccaaaggtgtattcgcctgtgctggtgcttcttcttgcttttgttcaaaatcgtcttcagaaatgacagcccagcccttaccctcaggcattggttggtccttctcttcttccgtcaagacttgaagtggcactgacaaagcaacgtattccatcaacgcttgatcaaaatcaatcaacccatcttcaattaaaataactgagtcttcgatttcataacgatcagcgtgctcttcgttttgcaagtaaacttcatcgatatcgaaatcaacatccatttcaaccggcgtcaatgaacgcgttgatggcgttaccaacttacccttcacgtttgcgtgaataatgatgtcttcacgatcagcttgcgcaaatccagtcaccgtcaatggggtaacgtccaatacaacgtcaccaaaggttgccaacaaaggctccttcaaatcaacgacctcgctgaattgcaatgattccgtcttgtacttttggagttcagcatattgccacttcatgtgattatcctctttctataaaaactggaatacgtcccgtgtctaacggtgacgctttgtcctgacgtgtccgtgagaattgttgatataggcgaccagcccggtaatcaagcattaggatgccagttaggtcatctttctcaactttatgtatcaacggcaacgtgaatgactcacgttgttgcttcaaatagcgacgaccaactggcgttgcgcctaacatgcgcaagtacggttgttgcatcgccgtttgcatctcagcatccgttatgttcaaaacggtgtataacaatgtgcgctgcaggcgtgcctgcgtgtaacgctttgacttgaacgtcgtcataaacgtttcgtagtcagctgttatattccgttcaatggtttctttaagacggtaagctaacccatccgtcaattgataaatggtttccaattcgtcaatcggcgtggtcagtaccttgtagcgtagcgcatcataccacgtttccgaccaatcagccgtttgcgcaccttgtgctaacaactcagctgcgggttgcgaaacatagtcagcaaattcagctgctgatgcctcctgattaatcaactcacgtagcgcggttgcactcgcgatgtgatcatctgaaagcgtcgtatcatgatatccagctttgatgcgctgaattggttggaggcgaatctgatccgctaaaccaagttcaataacggccgtagcgtaagcaaacccaagcatgtcattcggatccgtcaaacggaatccgacaacttctgccaaaacatcattaaaagctgtcgcataggtttgtgaataatcagcagaaaaatggtcatctgctgccaatcgttcacgggcctgttgcgcaagcgctaagaaatccagctcagcatgctcggcaccaaatacgatacttgaaacaccagcgtcagctagcagttgcacggcaccacgcgcaaaaatatgtgcgggttgtacagcaaacgcaaagggcagttcaaaaacaatatcgaccccaccagctaaagcgagttctgtgcgacgccacttatcaaaaacggcgggtaccccacgttgcacgtagttaccactcatgaccgccacaactgtatcagcaccagtaaccgcctttgcttgggcaacatggtaggcatgtccattatggaatggattatattcagttactaacccaactgcctccatgttatcctccaagctttacgctttcgtcgcgttaaagaaccagcgtggtgactcatcagtcacctctgatcgaccaaagtcagccgtcacttcaatgtttgtaaagccagcttcagtcaacaaacgcttgtatgtgtccaaagaatatgtgcgctcagtgtgtacttcttgcaattgttggaagccatcaatgtcttcgttataaacaaagaacgtcaattcatgttccaccgtatgtggttgttcttcaacaccatatgatgaccacataaacgccgtctcatcatcatgccagttatacatataaccaggataataaacgtccgtttgccatggtgaaatcacatcgaacaagaattgaccaccatcttccaagtgttcagcaacttgcttgaacgccatcaatgtttcgtcttcattagccaagtaattaaatgaatcagcaaatgatgtaatcgttgcaaaacgctcatcaaagtctgaccactcacgcatgtcgccttcaatcaatggcaagtccaattcggcttcttgcgagtgttgcgcagctagcgccaacatctcagtagacaagtctaaaactgaaatatcgtcataaccggcttgcttcaattgaattgccaagcgtcctgcaccaccggctagttccaatagcttaccatccttgttcttaatgaacttggttgcgtattggaaccaatctgcgtaggctgcttcgtcaaacaagtcgtcatacagcttcgcaaaagtttggtaattcattagaattcttccttaacgatccattggtcaatgtcaatttcaggtgcagcaccccacaacttttccaagttgtagaattggcgcatgtcgtccttaaagacgtgcacaaacaaatcaccaaagtccatcaagacccattcaccttcgcgacgaccttcgtgacgcttcaactcaaagccagcttcagccatcttgtcttcgatttgatcaacaatcgccaaaacttgacgttgcgttggggcatccaaaatcaagtaagcatctgataccaagctaatctcgtggatatccaatgcgaccaagttttcagcgcgcttttggtcagcagccttaacagccacttccaacatttcgtttacgttgctttccattattacttcacactccatgcgttgtatgtcaaaagcgtgcccggataaaccggaacctgcttttcaattaaataagcaagcgtgtggcccgtctgccacccgacacttgctgccaagtcttcaaatgccaaggtgcgaacttcttcaacacctgggaaatcgcgacctgactcaatatagtctgccatgtagataatttggctcagcgtcgtcatgtatggcgcaccagttgtgtgctgacgaattgctgtcaggatatcttcgttttcaatgcctagctcatccttcaccatttcggcgccgacgataccatgccaaacgttgtttccccaattaaccaaatctggatccaattgcttttcggcaatcttcgccaagaaatctgcatcagagcgttccttggcgtaatcatgcgtcaaggctgccacagatgctttctctgcatcaacaccccacttttcagccaaggccacagccatttcttcaacacgcaacacgtgttggaaacggtactctgacattgctgcttgggctgcttcaactaagcttttacgagaaccgttatagtaacggccccgataaatcatctcgtttgtcatccatgtataaccctttttctacaatgtaggctgctaccatgtcaggtagcagatagcgcacactttgcttattagcaatgcgcttacgaatatccgtcgaactaatttcaaggtttggcaccgcaacccattcaacaggataatccgttactcgtggttgtcctgggcgattaacaccaacgaagtgaaccaacttaaggaggtcatcaatgcgataccacgtctttaagtaagccacttcatcaccaccgataatgaaatagtattcgtaatttgggtgctccacctttagttgcaacattgtgttgtaggtatagctcttaccaccgcgttgtacttcaagcaattcaatgccaaagcgactattacctgcaatggccgcttggaccatcttggcacggtgcaatggatcaattgcttgcttcacatccacgtgtggtggcttcgcgttcggcatgaagtataccttatccaagccgagcttatctgccacttgttcagcgatgaccaagtggccaacatgtggcggattaaacgtgccacccaaaataccaattttctttgtttcaccgataaacgcacgctcagcttgcgcttgcgtgacggttttttcgattgtattaatcatgcccgaacccccgtttcgagagtgatattaaatcttctgtacagccactgagtagtgacggttttccttgtcagctgattcaccaaacaacaccaacgtgtgtccaattgtttgtacaacttggatgtccgtgttttcttcgatgaattccttcaaagactcaacttcaacgtctgagtttgccaagatattaaccttgaacaactcacgcttgttgatggcatcttctagttgatccaaccagttttgtgtcaatccttgcttaccaatgctaaacaatggacgcatgtcatgtgctgatgcgcgcaagtaacgcttttgctttccgcgtagtgaaatcatattaaatcattgcccttcgtgttaatactgaaaccccttcaggagcccagcctgctacaaccgtgttggcaggaactgtaatccagcccaaaccgtcaatcacgatatctgtcttctctgttaccttgaactcgtgacgttgcaatggtggcaacatgtccaagttctccgtcgttggtggcaacaacaattcaccagcgtgcttgctgtagaattcgtctgccttttccaacttggtacggtgaatcatcaagttgttctcgaagtatgccgtaataccagccttctcaccttggatgaagtcaaaacgagccaacgcacccatgaacaacgtttgttgtgggttcaattggtaagtctttggcttcaattccttttgtggtgaaacgtacttcaagtcctttggcgtcaagtagtgcgccatttggtcttggtgaatgatacctggtgtatcaatgataaacgtatcgtcatccaatggaatctcgatacgatccaacgtcgttcctgggaaacgtgacgtcgtaatcacatccttgttgtcacccgttgcatccttgatgatttggttaatcaacgttgacttaccaacattggtaacaccaacaacataaactgaacgaccttcacggtacttttcaatcatgtccatcaaagctggcacatcatcgccgctcttacctgacgtcaattgcacgtcgaccggacgcaaaccagcaatgttagcttgttgacgcatccaatccttaatctttgaacgcttcaaagactttggcaaaacgtcaaccttgttaccaactagcaaaactgggttatttccaacaaaacggtgcaaccctggaatcaatgaaccagagaagtcaaacacgtccataacgtaaacaaccaatgaatccgttgctgaaatttcgttcaacaacaaacggaaatcatcatccgtcaaatcaacgggttggatttcgttgtagtgacgcaaacggaagcagcgttggcacaacacttcttcgttttcaaatcccttcaacaaagctgacattggggcataacccaattcacccttgtgctcagtttggatcaacgcaccacatccaatgcatcgcaatccgtctgccaagtaaccttgaacttctgcttcactaatcaagtgtcgtcctccattgtagttctgggtgcgcctttagcatttgcttcttaacacccttttcaaaaaatcggttaatctttgtattccattggtcagtctcaatcagaggcttaaccaaaatgctacgtacgccgtggttgtttgatgaccagatatcagtcaacaattggtcaccgaccatcacgacttcgttcttttgtaaattaagctttgttacggcttcattcaagccacgtgtcaacggctttagggcacgtgacacaaacggtagattcaaaggctcagcaacacgtgcaatacgtgcagcagagttatttgaaacaatcattactgggatgccagcttcattcattcgctcaagccagtcatgcaattcagtcgtgccgtcagggttattccaagcaatcaacgtgttatccaagtcagtcaaaactgccttgataccttgtgcctgaagttgttctggcgtcaaacggtagattgcatcaatcatccaagttggtgtaaatgattcagtcatttttcgtccttttcacaatttgtcttactataaattatacgctaaatactgtcgtttataaagtggggcgactaggtcccaaataaaaaacaaccagcaacggaaaccatcgctgattgtttttaaaatctattacttagcgcgctcagcgttgtacttcttttcaccgacgtgttcttcacccaatgaaacgaagtcgtatgacaacttggcgttacgctcaaattcagccaaaccatagttaatgatttcgtcgatcaagttcgtgtagctcaagcctgatacttcccacatttgtggatacaaagaaatgtttgtaaatccaggcaacgtgtttggctcacccaagtatggtgtaccatcagcatcgatcataaagtccatacgcgtcaaaccaacaagacccaatgccttgtaggccgtcaatgccatgtcagtgatttccttttcaaggtcatcccccaactcaactggcaattcaaagaccattcctgaggcgtcaacgaacttgttgttgtagtcgtaccaaacgtcttgttcaggcaatacgataccacccaaacgtgatgcacgtggttgctcgtttcccaagattgagatgaagacctcacgtggcttgttcaaagcagcttcaaccaataccttgtagtcgtattgcaaagcgtccttaacaccagcctcgaattctgcggcgttcgttacgcgtgaaataccaactgaagaaccttgcttagcagccttaacgaacaaaacttccgtaccaagttcctttacaagaccttcgtatgtgtagttttggtaatcttggtccgtcaacaaaacgtacttcgtgttgcgtacgccagcttggttcaagatacgcttcgtcaaatccttgtcgaatgacatggctgacgcagccgtaccagcaccaatatatggcttttgtaacaaacggaacaacgcttgcaaagtaccatcttcacccaagttaccgtgaacaactgggtagaacaaatcgatttcagccatctcacccaaaacggcaattggtgccaatgggttcgtcaaatccatctttgacttcgctgcagctaccacagtgtcttcatcttcaccatcaaacacacgctttgaatcagcggcgttgatcatgtaaccatcctttgaaatcaagaaaacagttacgttgtacttttccttgtccattgcatcgtaaatgttacgagcagagcgctttgagacgtcgtgttctgatgagttaccaccaaagaacatcgcaatgtttagcttttctgacatgtcgttctccctgtcaaactgattgaatttagaaccctaagtataacacgaaactgtaaaccggaccgattacgctaggaaattgcgtgcttcgttaagataatcataaatttctttgggtaatttttcgcgtagcaacaaaccttgtagcaagcgttgttgattgtacatacggtgccaatctgcttcaacttccggttgcatgcgacgcgtcatttcttggcgccattgcttgagttgcttcaagaagtattgctcatacaacggattcaagttcaccaacgttacgatatagctatcgatacgacgattctcgcccatgaccagcggtgtttccaaacgcttgatgcgttcaatcaaaaccgtgagcaagaataccttatctgcgcgtgtcactgcatcgtcatgcgtcagctcatccaacaagtttgcgatgtgcaagaaagcatgtgcccaacccttgccttcaacaaaaccgcgcgtatcatgttctagcgcaatgtacgttgccaagttatcgataagcatttcgtgcaaatcgtcgctaaacagctctacttcactattgcgatttgcgtagttcaacatcgacaaaatgaagaccgcgaatgagcggaagaagatgccgtcattatcagcctcatcaatgtgtgagaacaacactgaatcttgtaataagtaacgcgtcatcatcacaatttgtgcatcggtaaagacattcgcttgcaacgcatcgctaataaagaaaaagacacccttatcacgcaactcaggatcagtttggcgcaacccactcatcacgtccaacaactcttggtcagtgacgacaaccggttgacccgcaatcaacgcattttgccaatcagacactttttcatgaattgcagtcgccgttatcggatcaagctgctcaacaacagtcggtgcgtcgtaatcaaactggtcaatcaaacgaccaacttccgttccaagtgaatcaaacaactcaccatggtgcacacgcgcacgcatattttttaattcttcacggacatcatcaacggtgtaatccattatctctatcccttttccgtattattgcttcctaaatgaaagctacctccactagattaacacaaccacgcaaagatagcagtttattatattttgtttccaaccgggtcgatgacacttcacccgattttcgttcatctagacacaatttgaacgtcggcgaaaacccgccatttcagcgtttattttctttcacccgtttttcacccatttagacacgattttcgcccgtctagacacgattttcgcccgtctagacacagtttgtttcacccgattattccctgtctagacacagtttgaactcgtaacgaagcctactatttcagcgtttattgtccttcacccgttttttgccaatttcgacacgttttccactgatttagacacaattcttatttgctgcagaaaaaaagccccagccgacacgcagtcgactgaggctaattcatctatctatttcaacaacaactattccttgaggtggaagtagtatgttgacacagttacgtcacgtgaagccaaggctgtacgcaaacgcaaactgttttgattgtgcaacgcattttgccaaccgtgacgaggcacgaattgtggaatcaaaatcgtcaatgagtggttacgttccttcgcaccctttgcaatttcatctacgaaacgcaatgaaggctctgtgattgaacgatatgacgagtggatgtccacgtaacgcacatctgggaactcgcgcttgaactcaacacccaaacggtgctccttttcagggttcgaatcaaatgagacgtgcatcgccaaaacgcgatcacccattgattgggcataatcaatcgcatcggccgttgccttagtcaagtttgagaccaacacaatcaccgtagaaccatcgtagtgatgacgcttgattggttccttagacaacacacgcaattgcttagcaaccgccttgtagtggcggttaatcgtccagaacatacgaagcaaaactggcatgataatcaagtatggccagacagacttaaagtgcatccagaacaaaatgataaccaaggcaaatgagataaacgctccaacaaagttgattgacgcctttcccaaccagaagccttcacgttcacggaaccagtgaataatcattcctgattgtgacaatgtgaatggcacgaaaactccgaccgcataaagcggaatcaaagcttcggttgatccgttaaaaatcaaaagcaacacaatggcaccaacggccaatgacataataccgtttgagtatcccaaacgatctcccttgtccatgtaaatgtgtggcatgaacttatccttagccaagttaaaggccaattgtgggaaagctgagaaaccagtattagcagcaaccgccaaaatcaaggccgttgcaatttgcaaaaggtagaacattacgccgtgaccgaaaatcgtttgaccaatttgggccaacaccgtcacgtggtcatttggtcgaataccgtaccagtatgacaagaacgtaataccaccaaagaagaaggccaaaatcaacgccatgattgatagcgtcgctgccgcattacgtggctttggctccttgaagttcggcacggcatttgaaatggcctcaactccagtcaatgaagatgaaccacttgagaacgcacgcaagaacaacaagattgtgatacttgatgatgacgtaccaattgctgcagcagcatggaaggcaacttgaccagtcgcaatgttatacaacccgtacaagaccattccagtaatcatcacaatgaacaagtaaaccggcaccatcaggaacccggctgactcacgcacaccacgcaggttaattcccatcaagattaagatgataacaaccccaatccctactgagtatgggtgaagcgcaggaactgctgacgtaatggcttctgttccggccgccacagatacggcaaccgtcaacatgtagtcaaccaacaaagatccaccggcgacaagcccagcgttacggccccagttcgttgatgttacgacataagcaccaccaccagatgggtaggcgtgaatgatttggcgatacgatagcgtaatggccgtcaacaataccaacaccaaaatggcgattgggatttgcaaccacaacgcaaccgtacttgcagcaatcaacgctgtcgtaatctgctcagtaccatacgcaactgatgacaatgcatcagacgaaagcaaagccaaggccttggttcggctcaaatgttgtgagccctcttccaatgtcttaagaggctttccaatcaacaaccgctttaaaaagcgccacatgatttttctcctaaacacctatattaggcaaaacgcccaaaaataatttcaattttctacaacgacttattgtagttctatttgggctcgttgtctatgattgatacttactttcggaaatcaaaaacgccaaccctctcacaggaaggtcggcgtttaatatttactatgaaattacatcatacccggcataccttgagcaggcattgcaggggcagcatctgtcttaggttgctcagcaacgacagcttcagtcgtcaacaacaaagctgaaacagaagcggcgttttgcaaagctgaacgcgttaccttagtaggatccacgataccagcttcaatcatatcaacccattcatcagtcgcagcgttgtaaccaacacctggcttctctgacttcaattggttaacgataactgaaccttccaaaccagcattttcagcgatttggcgtacaggctcttccaaagcgcgacgcacgatgttgataccagtttgcacatcaccagtctctgacaactcagcaacggctgggataacgtttaccaaggcagttccaccaccagcaacgaatccttcttcaacagcggcacgagtagcgttcaaagcgtcttcaatgcggtacttgcgctccttcaactcagtttcagttgcggcaccaacgttgatgacagcgacaccaccagccaacttagccaaacgttcttgcaacttctcacggtcaaagtcagacgttgtctcggcgatttgacccttaatcaagttcacacgctcagcgatagcttccttgtttccggcaccttcaacaatcgtcgtgttgtccttagaaaccgtaaccttagcagcttgtccaagttgtgcaatcgtcacatccttcaagttcaaaccaaggtcgtcagtgatgacagttccaccagtcaagatagcgatgtcttccaattgcgccttacgacggtcaccaaatccaggtgccttaaccgcaaccacgttgaacgttccacgcatcttgttcaaaacaagcgttggcaacgcttcaccagtaatgtcatcagcgatgatcaacaaagcacggccttgctcaacaacactttgcaacattggcaaaatttcttggatgttggcaatcttcttatcagtaatcaagatgtatgggttatccaatgaagcttccatcttgtccgtgtcagttaccatgtattgtgacatgtaaccacggtcgaattgcataccttcaacgacatccaacgtcgtctcgatacccttagactcttcaatcgtgataacaccatcgttaccaaccttctccatcgcttcggcaatcaactcaccaacttctgggttagcggctgaaattgaggcgatttgggcgatttcttccttagtagaaaccgtctttgacatctcgtgcaacgccttaacagctgcatcagttgccaattcaataccacgacgcacaccaactgggttagcaccagcagtgacgttcttcaagccttcgttaatgatagcttgcgtcaaaacagttgcggtcgtcgtaccgtcaccggcaatgtcattcgtctttgaagcaacttcggctaccaacttggcacccatgtcttcgaagtgatcttccaattcgattgacttagcgattgttacaccgtcgtttgtaatagttggtgcaccatagctttgctcaataacaacgttacgtccctttggaccaatcgttgtcttaactgtgttagcaagcttatcaacacctgcttgcatctttgcacgtgcatcttcagcaaacttaatgtccttagccatatttatttcaccctctatttcaaatttttaatagttaatctgtttgtttcaaattaaagaactgcaacgatatccttttcgtgaactaccaagtaatccacaccatcgaccgttacttctgagccagcatacttatcgaagatgaccttgtcaccctccttcactgcagctggggccgtcaagtcaccaactgattgcgttgaaacagcgacaacagttcccgtaactgacttctcttgcgcgtttgacgcaagcaaaataccaccaactgattgctcaggcgcttcctcaacttgcaacacaacacgatctcccaaaggcttcaacatgttatatgacctccataggcaaaaattattattagcactctcgataactaagtgctaacttacatattcaataatagcacacccacacgtttttgcaacatattttggttaaaaaaagagtcctgatacgaaatcgtaccaggactctaaataatcattacttcaattgtgacaacatttgcttcattgctgttgccgtcatttcagcagtttgttcagttgtataagccttaacttggtcaggtgtagcctttgggttagcttgcatgtacgcagcaaccttcgcttcaatagctgacttcatttgagcttgttgagcagcttgtgcctcaggtgcagctgacttttgggcagcttgcaacttcttagattgatcagcagtcatcacaacccaagtgttctttggcactgtcaccgtcgtcacttgcttcttaagcttgccaccttggccaccaataccgaacatcacgcgccagaaggcattcttccactcccaacgagtcgtttcgaccttaacagttgccttcttaacgtcagcaaccttgtaagtcattttcttcttaacaccgtttggaatatcagcaaccttcgttgaaggcttaccgtgaaccgttggcttcttagcatcagctgtgtcgctgtaaaccaagacatagttatcagcctttgaacccaaacgtgattggaccaagacaccagctggtgactttgaacccaaagctgagtagacacgcttcgtcgtcgttgttgtcttagcagtcaaacctgtgttgtttgcaaagactgacgttgtcatccacacggcgccgattagcaataccgtgaagataggtccgaagatagcgcgcatagtacggttcttcaaaaccaaccatgagtagaacatgccgatcgcaaagacggccataactagaataatcatattagttatttcctcccttatctgcgacaacgtttccgtttgacttaccgtgcactagcttaccgctgtgcaagaagaacgccaagataataccaacaacggcgaatccaattccaaatgcaaatgatgcgtggaatccagtcatcgttgcgttaatcatcttatccatgtaagacacaacgttttccttggccaagtccttagcaggcttagcagccttgataacgttttgcgtaactgatgaaagcaaggcaacaaccaccgcgttaccaatttggcgaaccgtgttgttagcagccgttgcttgtgaagcttcctcaggtggcaaagctgacatggcactggccgtcaatggcatcatcgttgtagcgataccgaacatacgcaatgcgtacaacaacgttaccaagtgttgtggcgtttcagccgtcaagaataggaatggcactgtaccgatggccaagattgagaatccaaccatcgccatgcgcttagcaccaaccttgtcgtaaaccgctccggcaactggtgacatcgcaccaattaccaaggcaccaggcaatagcgtcaatcctgactcaagcgctgacataccgtgaacgttttgcaagtacgttggcaacatcatttcgacacccatcatggccatcatcgccatcattacggcgaacgtcgtcaacgtaaattgcttgttcttgaacacgcgaacgttcaagaatggatcgtccatcttcaattgacggaaggcaaacacaataatgaccaaaattccgattaggattggggccaaaacacttggccagttaccaaatccatcagtggctgagtttgagaatccccataggaatgatccgaatccaataacagccaaaatcaatgaagggaaatcaagcttcatatcacggtttggcacaacattcttaacgaagaatggcgttgcaatccaaaccaagaccaatacgatcattggcaagtagaaaatcgtacgccatgagtttgaaatcaacaaaccaaacaagtggtgattcttttccaaaatccaacctgaaagcgtaggtccaatagctggggccaaaccgataacgataccgttaatacccatcgcagcaccacgttgttcagctgggaaaatgttaaccataacaacttgcatcaaaggcatcgtaataccaaccgccacggcagctagaatacgtccaagcaagaacatccaccacatgtcgtgatgactaggcgtaaacaccgtcgttgccataccagccaacaacaatgtgtaagcgaccatgtacaagtacttggttggaatcttagtggttaggtatgctgataccggcaccataattccgtttgccaacaaaaagtatgtcgttgcttcttgggccgttgcaagtgaaatattaaaatcgtgcatcaacgttgggattgctgttcccaatgacgtttgcatcaacattccagcaaacgttccaatcaacagcaccataaccatggcaccgcggttgaaaggcttgccgttaatgtctaaagtttctgactttgccatttcgtcctccaaattagtttattttttataattgctatcatttattcagcaagagttagtttaaacttctaaatttttaaaatcaagggtttttgtcaactaatttgacaaagatttagactgttttcacaatagcaaattgaattccgtgcaaactgcgtcaatcctgaatttctaagtgtgataactaacacaaagtcattaaaagtcactttaaaatgaaaacgcaatcattaagaaaaggagctgacacccgtaaaagtgccagctcccgcctcattaaatatcaaattcttccaacgccatacttgcttctgtccagcgttcttcgacttcagccaattgtgcatcgatgtccgcaatttcctttgacaagtccgtcaacttacccaagtcagcaccgtttgccggatcattcaattcagcattcaatgcatcgcgcttatcgttcaaaccagccatttcttcttcagccgcagcaaccgcacgttcgtacttacgttgctccttttgacgttccttacgctcttcacgtgacaacgtctcaacttccttagcagttgcttcttcgtattcggccgtcgtttcaaaactagcctttgcacgatgcgtttctgtttgctcaccagccgtcttctctaggtagtaatcgtagtcaccatcaaagaagcgcgtcccgtttggtgacagctcgaccacttccgtcgcaactgagttaatgaagtaacggtcgtgagaaacgaagaaaatcgttccgttgtattcgttcaacgccgtttccaacacttcacgagaatcaatgtccaagtgattggttggctcatcgagaatcaagaagttagcatgttgcaatgacaacttcgtcaatagcaagcgcgcacgctcaccacctgacaaggcagaaaccaacttatcaaccgcttcacctgagaacataaatgaacccaaaatcgaacggacgtcacgttctggcatcgttgggtgttcatcccaaatcgtgttcaaaactgacttctttggatcaagcgtttgttgctcctggtcatagtaaccaacctcaacattggcaccaagcttgatttcaccggccaacaaaggcaacttacccaaaatcgtcttaatcaacgttgacttaccaataccgtttggtccaaccaaagcgacagcgtgttgcttatcaacttcaatattaacgtggtccgccaatacattcgctaggtcatagcccaacttcacttcgttgacgcgcatcacttcgtttccagattcttcatcagctgagaattgaatgtgtgcaacaccagattcattctttggcgcttccaagcgttccatgcgttcaagttgcttgcgacgtgattgcgcacgcttcgtcgttgacgcacgcacaatattacggttaacgaagtcttccaacttggcaatctcttcttgctgcttatcgaaagccttttgctcttgtagaacctttgccgccttcaattccatgaagcgtgaatagttacctgtgtaatgatccaagacacctgagtgcatgtcataaatttccgtaaccacgcggtccaagaagtaacggtcgtgggaaacaatcaacaacgcgccttggtagttttgcaaatattgctccaaccaagccaacgtttgcatgtccaagtggttggttggctcgtcaagaatcaacaagtcaggcgtttccaacagttgcttggcaatcgccaaacgcgtgcgctgtccaccagacaatgattgaatcttttgatcatagaatgactcatcaaaaccaaatccatgcaaaacggaacgaatcgtcgcttcgtaaccgtaaccattcttctcactaaaatcgtgttgcgcttggtcataagcagatagcaaacttgcatactcatcactctcgtaatcagtagccgaagcaatcttcgtctccatgtcgcgcatcttcttttccaatgcaatgacatcagaaaatgcatcaagcatctcattgtacacagacaaatcagaatccagtcctgagttctgcgccaagtaagccaacttgatacccttcttcattgaaatcgtaccttcatcaggttgcgtttcaccgattagcatcttcaagagcgttgacttaccggcaccattgcggccaaccaatccaacgcgtcctttatcttgaatctgcatcgaaatattttcaaaaaatgttacaccactaaaacggcgtgcaacattacttgcttgcaaaataatcatgattattcttctccgtctcaacaccctgcgtccaaggcattgcctaaatctcatttactagtgtaacagaaagtgcaagtttgtcgcatgtggaaattaaaaagcacccgacagtaactgtcagatgctcttaattgtttgttattaacgcaacgctgcgtttcgcttttgttgctcgtgttgcacgaaatactcccatgcatgcatttcactctcaaaccacaaatgctcaccgtcataatccaatacttccaatgacgtttgcaccaatggccactcagtgtttggcttgccttctaggtgttgccacataaatgacgcacgggctgcaatatcaccagttggtgtgtagaaaatgatgttcgatacatttcccgtcgtttgataataacgcgttgctgacttaaagccacgccagtcccagatatctgtaacggccgtgttatcattgcggtcgacatagtgcaacattgacgtcgtaccgccagggttgcctgggaacaaatcaatgtcgatgacattacgaccataagttgtcccaaaacgacgcgcttgtgccatcccccagtccaacccatccaagtggtaacgggccttgtcgatttgtgggttgtgacggtagtgaaccgtctttgtttccacatccgttgccttttggaagacatcgtacatgttcaacaaagcatcatctggcaaaccgtggttcgctaaatgcatgtgttgatcagggtagtacccacgcaccacttgctttgcatcaacgccattctcgcggtctgtcttaacttgcgcagcaatattagggtcaagcgttggcaagttagagttatccaaatataaattcatgagtttcactccttattaatctgccaagtacttgtcgcctgaaatgccgttaatcgtcacttcatcactgcgattaccaagtgtgtaggctgtcatcgtcgttccaccaagaccaacaccaacattagaaagggcatgtgcttgttcagccatggctggccaacgcttatcagcatcagctagcaaaccttgccatgcttgccaaacagcttcttcgtagtaacggtcattgtggtcgtatgcagcatcagagaaagcttgcaacttttcaggatcattaaataactcaaggaagcggtcggccatttccgttacgaattggtcttcttgaccctcaggtgcccactttgttaggtaaccgttctcgccatcgataatcaaatcgtttggtccgtagttcacgttcgttgaaacaccaggcataccgtttgccatggcttccatcattgaaatgttgaacccttccatcattgaagccaatccataaacttggtgtgaacggtgaatagcgtacaactcatcacggtcagtcacataatcatgcaacgttacaaccggtgattccaaacgacgcacttgattcaaatccgtcgtttcggcgcccttttcatcgtacatggttggcttttctagtccgtacttatcgaacaaacgcaacaagtccttattcgtcttgttgttacccgtgttatcgaagtaaccgtagacatccaagtgtgcattcaaaccaggttgcttttggttagcaatcatcaacgcttcagcaaccgcggctgggcgcttgtctggtgcgcgacgaacaatcatcaacactgaatttggttgacggtcagccattggcacacggtcagcttcacgaatttcagctggtaccacaccaactggaatcgtgaatggcgttgcctttggtgcgtaacgcgccacaacgtccgccgtttgacgtggcatcgctgaaataaccgcttggtaatcattgatgtgcatgaagtcgaactcgtaattattgttctcatcagtcgtcatgacatcacgcgtgtctgaggcatgcaaattgtgcaagtggaagccaatgtatgcaggccgatccaacttcaacaagccttcatcggcagccgtcgtacggtccatgatgaagatgtttggcgcatcctctgagaagaagtcgttattcaaatcgttaacgaactcagccgtcaattcatcaaatgaatcaaagatatacgtcatgccatttggcttaatcaaacgatatcctgacacatagtttacaaattgtggcgcttcaaatggcttggcttcaaattcttgccctgacatttgtgcgttctcagccaattggttttggctatcgatatgcttacggttcatgaccagcgtttctgaaccacgaggcgccttgcgacgaagatattcttcaatcacagggcgacccttgcgatcaacaaagacgttggtatttggcgtaccatctgggtcgatgtattgctgacgtgaaatgaagccacgtgagtcatatgaatcgacgcggaacaagttaccaaagtgttcgaatacttcaaccatcgtgacacgtgattcgtgttgcaaatcgacgtgaattcgacccaagaaacgggtacggtttacatcctcataggccatgtatgtgtctggcgtatcaggcaattgttcaacaatcgccaccggacggccgccccactcaacatcttgcgccgtcaaaatgcgatccggcacatattcagtatgtgcgtagtaatcatacatattgattacttcagcatcgttcaatccccacgctagcaagtctcggtgcccatttggattaaacacacgcgtgacaattttgaatgattgtccattcttacggaacaacttaccacgttgtacctgtgcgtgttcaattcctgaaccttgcgcggcgaggccctcgtttacgaaaaagttcatcgcaataccctctttaactagttttattaggctaagtataccaaacccgcttacaaaaactaaacccaacccatgcgcacttctgaaacaaaatataacgaacctgtgaacaaaatcatatcatcaggacccattgcatcagcgattgtgcgataagcttctcgccaagattcatgaaccgtgacatcatgccccgtcacttggcgtgctgcttccgttggatcaagtgcgacgcgagcacccggattttggaagtgcgtgacgtgcaaatcaacattgggtaaatctgccaacgtatgtaacattgctgaatagttcttatcggccaatgcaccgaaaatgacgtgaatctgcttatccgcaaaacgcgtccgtaacgtttcagccaatgcatcaaccccgtgttgattgtgggcgccatccaagacggtcaacggttgctctgaaacacgttcaaaccgtaccggccacgtcactgtttgcaaggcctttgctaccatttcagctgtcagtggcacacccaattcatcgaccactaaacttgctgcttcaagggcaaccccggcattatcaatttgataattacccatcaaatccacaaaaacatccttaaactcgtgaacacccgcgaagtcgaaggtctcaccccaacttgtttggcttggcaacatctcggcttcaaactcatcccccaagcgatacagcggcgcacccagagcattggccacgtttgtcacaacttgttgggcttcttcaggcaatcggccagtcacaaccggacgttgacgcgcaatgatgcccgacttttgcgtcgcaatctcagcaagcgtgtttcctaacacttgcatgtgatctaagccaactgtcgtgataaccgataccaacttatctggaatcacttcagtcgtatcccaggtaccaccgataccgacttccaatacaacgacatcaacagggtgctcagcaaaatacacaaacatcatcgctgtcaacgtctcaaactcggtcggaccaccctgaggcaactcttcgtctagcacttcagtgattggtgcgatgcgacgcataatatccaacaaaatatcatccggaatattaccgtcattcccttgtacacgttcattgaattgcaaaataaatggcgacgtgaacatccccaccgtcaagccagccgcacgcaataattgcgcaatcatcttgctagtcgatcctttaccattcgtccccgtcacatgcacatacttagacgcacgttctgggtgacccaaacggtctaataaagcattaatgcgatcaaaactaggggtcttcttccacttgtgtcgaccatgaatatacgcaatcgcgtccgctgctgtgttcagttcaatcatgatgtcgccttcttccgtttttcattagcaatatcgtatcacaccggcatttttctggtgcattttttaggcaaaaagtaaaggcgccatctatcgaaatagacagcgcctttacaggtgtaatttaactagcattgtaacgacgaacagcttaaattcgttattaacaatatataagatattactccaaaaactcgcatcctgcaagcctttagacgtaacaatctgattacttagctgacttcaactcttccaaacgtgattcagtcgctgccaacttagcttgccagtcagccaacttctcgcgttcttccgcaacaacagcttcaggggcgttgttcacgaacttctcgttacccaacttaccttcagcgcgcttaacttcaccagcaaacttcttcaagtcaccttgcaaacgggcgatttcttcgtccaaatcaatcaactcttccaacggcacgtagacttcagcaccagaaataatttgcgtcatagccaactttggtgcagctacatcagcagaaatttcaagtgactttggctttacaaagcggttgatgtagtctgagttttcatcaaagatgcgggccaagttctcatctgatgtcttgatcaaaacgtcgatttcggttgacattggtgcgttagcttccgtacggatggtacgaacggccttgatcaagtcagtcaagctttggaagtcagcttcagccgttgggttgtccaattcagccttcacttctgggtaagcagcaaccacgattgactcaccgtcatgtggcatctcttgccagatagcttccgttacgaatggcatgattgggtgtagcaaacgcaatgtgttgtccaaaacgtatgccaaaactgcttgtacgttcttcttagcagcctcatcatttccgttcaacgtttccttggtcatctcgatgtaccagtcggcgaagtcgttccagatgaagttgtacaatgaacgtccagcttcaccgaactcgaacttatcaaagttcttcgttactgaagcaattgtctcgttcaaacgtgacaaaatccacttgtcggccaacgtcaaaactgacaagtcagcaggcaattcggccttcgtttcgtcatccaagttcatgataacgtaacgtgaagcgttccaaatcttgttgatgaagttccaagctgagtccatcttcgtgtatgagaaacgaacgtccaaacctggcgttgaaccagttgccaagaaccagcgcaatgcatcggcaccgtacttctcgatgacatccattgggtcaattccgttacccaatgactttgacatcttgcgtccttgttcgtcacgaatcaagccgtgaatcaaaacgttcttaaatggacgacgacccgtgaattcctttgattggaacatcatacgagcaacccagaagaagatgatgtcgtatcccgtaaccaacgtgtttgttgggaagtaacgcttgaagtcttcagcgtcttcatcaggccagcccatcgttgagaatggccacaaagctgatgagaaccacgtatccaaaacgtcagagtcttgctcccagttttcgatatcttcaggtgcttccataccaacgtacatctcacccgtttgcttgtggtaccaagctgggatttggtgtccccaccatagttgacgtgagataacccagtcgtggatgttgtccatccaacgcgtgaaggtatcttcgaaacgtggtgggtagaagtcaacgcggtcgtctgacttttgcatgtccaaagcttgctcagccaatggcttcatcttaacgaaccattgcgttgacaaacgtgactcaactggcacaccagtacgctctgagtgaccaactgagtgaacgattggctcaatctcaagcatccaaccttcagcttgcaagtcatcaacaatggccttacgtgcatcaaagcgatccataccaacatacttgccggcacgctcgttcattgatgcatcttcgttcattgtgttgatacgctccaagttgtggcggttaccaacaccaaagtcgttagggtcgtgggctggtgtaatcttaaccattcctgaaccaaactctgggtcaacgtattcgtcggcgataataggaatctcgcgaccaacaagtggtacgcgaaccatcttaccaaccaaatccttgtagcgttcgtctgatgggtgaacagcaacagcaacgtcaccaaacatcgtttcaggacgcgtcgttgcaatttcaatgtagtccttaccatcgtaagtgacaccttcttcaacgaatgggtacttaacgtggtagaaagcaccttcatcgtcttggtggataacttcgatatctgacaaagccgtacgagccttaggatcccagttgatgatgtactcaccacggtagatcaagcccttttcgtacaacgtcacaaagaccttgcgaacggcttctgacaatccttcgtccaacgtgaaacgctcacgtgagtagtccaaagaaagtcccatcttaccccattgtgacttgatggtagcagcgtattcgttcttccagtcccaaacttggtcaacgaacttttcgcgacccaagtcgtaacgtgaaatgccttgttcagccaaacgttgttcaaccttagcttgtgtagcgattccggcgtggtccattcctggcaaccacaacgtgtcaaatccttgcatacgcttttgacggataatcatatcttgcaacgtcgtgtcccaagcgtgtcccaagtgcaacttacccgtaacgtttggtggtggaataacgattgagtaaggacgagccttatcgtttcctgatggcttaaagcggttttcttgtacccacttatcgtaacggccagcttcaacagctgacgcgtcatactttccaggcatatcaatttcgcgcatgtgaaattctccttataacataatctctatttgtgtaacgatatggcgagcaataaaaaacgccctgaccatacaataactgtatgatcagggcgacttaatcgcggtaccacctgatttaacgggacttctcccgctatctcgttagaacttaacgcgtttctcacgttaccgactactacaatttcaccggcaaggcccactaactaccttcagtcaagaattttgatgcgcttttcaccaaccgcgcactcgctgcacaatcctcattgacttactttttagtgcattgctataaacgtaattgtacggttatttgctttgaaaatcaaggtgaaagactagtgttcaaagaagaacgatatcatgcgatcaaccaagggcgtaagaaataaaacaacaatcatcatcttatagaacttcagtgactcaaagatttgatcaatacggacatttagtgacttcaattctcccctcatctcgcccttaaaatccgataaatctatgcgaatgtcgttcatttcagagtgaatcccctttaactcagttcggatatccttgatatcgtcccgtacctcttggaaatcatgcttcttaaaatcatcaaacgccgcgtacgtcacgtaacgctctgtctttgtttcggtcattttcgtctcctcctcgttgactattaacaccgtatccatatccccataaaacagataaagagacgccgaagcgtccctttatcgttaagtccagtatatcagatttagtggaagaacaacatccccgctgcctcatataataggtacaaaccgtacccgataacaatgaaagcggaaacgatgttcacccagaccagcgcacgcttaggcaagcgttctttcagcaaattcatggtgattgtaataccattgaaccaaatgaagctggcagtaataacaccgatgatgaatggccaaacttggttgtcagccagtgtcccgcgcaatgctccaagcattagcgagccatcgattagcgcttgcggattggcccatgacacaatcaccgccgttagcatcgcctttttcatcgtcatggcattttgctgcgtgttcaattgcactgagttagcaccacgtagaatgccatacccaatccaaataaccagcaagccaccgagtagcatgacaatcagcttcaacatttcatgcgaactgatcagtgcgcccatcccaaagaacgccgccattgaaaaggcagcatcggctagccaaacgaacaagacatacagaaaagcccgacggaggcgattattcatggcattgttaaacacatacaaattttgcataccgattggcgcaataaatgcaaacccaatcatcatgcccttcaaaactgtcatcatagctttcactccccttcatcactgctatccagtatacaagaaatccagtcccggcactacctgaacaggtaaatccagctcatctagtttacaacactagatgttaaggttatactatacttatcaattagaaatcagggggatttaagcatgccaatcctaacaaaagaaaatcgcaaatacttaattacatatgaaacgttgaacgctgtgacccacggtttgggtgtgctagccgctgtcgttggtgcaacgctactcctctgggaaagcatgcacgcaaacttcaactggttcaccatggcagccctatggatttatgccatctcaatcatcacattcctactcgcctcaacgctcttccacgctttggtgttcaccaaatccggaaagattttccaattccttgatcactctggtatctacctcgtcatccttggaagctacacgccatatacatggctattcctaccaggtaaagttggctggccgatttggattactatccttctgttgaccatcgccggaatcatttatgatttgttcttcgttgggcgctggccatggctgtcagtcttgatttatgtcatcatgggctggttaatcatcttggctttcccagcactgcacgcctcattaaccccatttgccttcaacttattgttggctggtggtatcacctacacacttggtgctggtgtttacctcattccaaaactgcctatgagccacgtatactggcacttgtttgttctgggtggcgcaacattgatgtacatttcaatctttagcatgctattctaaaaaaataacgggcaagcacaatttcagtgcttgcccgttttcgtttacttcttaaccgttccagccgttacccagttggtaaagtcttggttttcatcttgttgttgaccaccttgttggtgattcgtgtaatcgttcttttgttgttgtgagaacgttgcccaaacagatccaccaatgtagtagcgacttgatgccaacaaaacatccttcatgttcgcttgcttggcatccccaactgacgctgcattcttgatttgatcaccagtccagtaactagcgaccgcgtactccaaaccatcttgcaactttacttgacgggcgatgtacacgttttgcacatccttagccttggctgctgcttgcaccaccgttacaactgcagatgcatatgcgttggtgtacttatcaaaatcttgcgttgtgtcatcttgcaacacaatctttgccgtcccattgttaacatccgctgacaaaacagatggcgccaacttatttgccttaagcaccttcgtgacatcgaacgcaactggctcgctagatgacttagctgtcgtctttgatgaaactgttttattatctttgtgactcgttactgaagacttttcggatgattgcgtagattcagatttgtgtgaaccaccgccaaccaaggcaaaaattgccacgattccaataattaatacaatcccagaaataacggcacgcttatacttagccatatgaataacctcttctattacttgctactttaaacattttatcacaaaaccacttgcctattatgtccttcgtagtgcataatattatttgttgacgcctccttagctcagctggttagagcaacggacttttaatccgcgggtccagggttcgaatccctgagggggtataaaccgtcagcgttaaaaagaccggtatcttttgcgagataccggtctttttgtctgcttattacttaccaaacaactttgagaagaacccaaatagtcctgatgacttttcgtgttggcgtgacaaacgtgaatcatctgccactgctgatgcctcttcaggaatatcaacttgtgtcgtctcagccgctggttcaaatggctttggttggtcattggcctcaattgctgccgcagctgcctcgttagcttccttggcagccttttcttgcgcaacgtactcagcaatcatgtcatccgtcaaagctggcattgccaacgtcttcgtcgtaacacccatcgtgacaatcgcttgaccatccttaccagaacgacggctcttagcacgcacctcaacttgtgatggtaccgtgtcagttggcaactcaagctcgaattcaaggctcttatcaacgagcaagaagatttcgtctgccccgtgcaactttacagtcacatcgacatccgcttggttaacgcgtccttcaagcaaacgcttatcgccttgcgttgaaataacagccgttaccaccggtgctggcaattcgattgtcaatgtaaccttttcttctgatgatgcatcgccgggcatcttaccagttacgataatgtcaccttctagcaagccagctggcgcctttgccatgaactcaccgtttggatcagacaccaacgtatcttctttaccgttaggatatgtaaccgttataattgctgctggtgccgcgtgccccataacagtcgtgcccaaactgtttgttaaggtcgaagcgaccaaatttacttttgtatcattcatgatgtcagctactccatctctaataaactgttaatattactaccattgtaacagattaaacactcaccgacgacctaatcctatttatataataaaaggccggaacataaatgtcccgacctcacaggtttctttacttagcacgaacaatcaacgtatcaacgtttgctgtacgcgttacgtattcagtaactgatccaatcaacaagcgctcaatggcgttcaaaccagtagcaccaatcataatcaaatcaacattcaacttctcaggtgcttggtgagcaatgatgtcctttggtgaaccatactcaatcgtgtagtccacgttcttaacaccagcatccttagcttgttgcaagtaagtttccaacgtcttcttagcagtttcagcaacttgctcgaccatcgtcgtcttgaagtccgttacgttttggaatgcgcgtgtgtcgataacgtgcaaaatgtgcaagttagcgtcttccccattacgcaatgcaacttgaattgccttccccaaagcagcttcagcttcctttgatccatcaactggaatcaaaatgttcttgtagtttacattagtatcagccatgatagttcctcctctaagtggctatttgcctatatgttcattatacgccatttgtaataaatttgataaataaaccatgtctaaaaaaaatagcacctatgaagatttcacagatgctacaacgaaaatatgactatttaaacaaacgcgacgtgaccacgactgccaataccgtcgttagaatggttgccaaaatcacgaagatccccgctggcaatggtgctgaaccatgcaacacaacactaatgatcaatgccaatgcgtcaatcgtgaagaaccaaccgaaaaatgtggctggcatgctcgcttgtgatgctgacaagttaaaaaatccttgacggtgcgttagtagataaatgcccattgcgccaatcaacaacgcaaagacaagatacataataatgatgcccatttcattcatcctctatctcaaaaaataataattgcaaaagaaaagcgctaccagggctaaccgtggtagcgcacgaacacttgattggcgccgttaacgattcacaatgagttgactccagattataggtaagtgggtgaataagtcagctttagcggctactaagtgaaatagcttgcctcgccggcttcccgacatccccggtcaatatggttgtaaagcaactacatatagtaggaatcatgcgtacgtccaaggaattcgcataccgttattatacgcttccaagtgcaaaaaagcagtagttaacgtaaaccatttttctgggcgtcacgtagcttttggtactgttccttgtaggcttgctctaccttagaatttcccgctggcacgaagtagttcgccccgttaagtttatctggcaaatattgttgcggtacccaatcgccgggatgaccgtgtggataaacgtattccacaccgtgcccaagtttttcagcacccttgtaatgcgcatcacgcaaatgatctggcacgtcgccagtcccacccttacgcacatcagccaaggcggcatcaattgcagtgtacgctgaattcgacttgggtgacaacgccaattcaatcgtcgcatttgccaacggaatccgcgcttctgggaagccgagtttctcagctgcttcaatcgccgtcacggcacgcgccgcaaccgccggatttgccaaaccaatatcttcgtaggcaattacacgcaaacgacgtgcaataattggcaagtcaccagcttcgatcaagcgggccaaatagtgcaacgccgcatcggtatcactaccacgaatcgacttctgcaaagctgagatgacgtcatagtggccatccccatccttgtctgccgtcaacgctttacgttgcactgtctcttcaacaatcggcaacgtgatgtgcaccttgccatcttcacttggcgccgtcgacttaaccgccaactccaagccgttcaatgctgaacgcaaatcaccattcgttgcataaaccaattggcgttcggcctcatcatccaacaccgcatcaaagttccccaagccacgttctttatccgttaacgctctttgaatagctgtcttcatatcatcttcagacaacggcttcacttcaaagatttgcgtacgtgaacggatggccggcaaaattgatagatatggattttcagtcgtcgcaccaatcaacacaatacgcccactctcaagatgtggcaacaaaaaatcttgctttgtcttatctaaacggtgaatctcgtctaacaacaaaacgaccgtgccagacatcttggcttcttcggccacaatttggaggtcctttttactatccgttgcggcattcaaaatgcgaaacgcatacttagttgaccccgcaatcgcactagcaatacttgtctttcccgtgcctggtggtccatataaaatcattgatgatagcatcttagccgtcaccatgcgattaataattttgccctcaccaactagatgtcgctgaccaacaatctcatcaatcgttcggggccgcatgcgaaacgcaagtggttgttgcatgctgcttcaccttctttcttattatccaaacaactttttgtaccaaggcttctgtggagcatctggcattcccgttttttcctcatcatcttccaacgtcagcgccaccacatcaatttgtgtgatgttaacagcttccttcgccgttaaaaccgcaacaacatctgaacgatcataaacatcatctgacttcaacgtaaagccaacattgtacttagatgccagtttgatatacggcgtcaacaattccatatcaagatgcccgtttaatagcaaagtcgcatccttatgctctttcagttgcgtctcccaagttggcatgtatttcgtatcaccaaaggttgcccgtgtctgcgcaacatagatacgctcgcgaaacgtgcccaaatagtgattttgttcatcagggttaatctttggcgtcccgtagacggccgcttgtacgtgtggatccatgtcaggcatattcgtgtcctccggtttcttattaggttaagtttaacatataacaatatgtaaacaaaaaagagcccacaaaatgcgaactctaacttgtacttatattatccgaacatcaaagttgaaatccccgctacaaaaacgtacatcatatatgcgccaaaaatccagtgtagtgcattaaacaacattgggaatggtcgcaagatgcggtggcctgcaaagtagaccaccgttggtacgatcaaaatcaacgcaaatatttcaaaccccattagccatgtgttcggtgccattggcatcaaaagtgtcatagcttctcctccaaatcaacatctgggtacttatccttaaaccagcgttctgcgaattggttttcgaacaagaatactggttgctcagcacggtcacgtactagcaagttacgtgatgaagccatacgtggatcaagttgctctgggttaatccagcgggcaatctttgaacccattggctccaagctaacttccgtgttgtattcgttttccatacggaattggaaaacttcgaattgcaacgcaccaacggcaccgaggatgtagtcccctgaatcccaggccgtgtacatttgaatcgttccttcttgaaccaattgggtcacacccttgtggaatgacttttgcttcaaaacgttcttagcgtgaacacgcatgaacaattcaggtgtaaacgttggcaattcttcaaattcaaccgccttcttaccagcgaaaatcgtgtcaccgatttggaagttacccgtgtcataaacaccgataatatcacctggataagcgttctcaacgttctcacgcgtatcggccatgaattgtgtcacgttagacaaacgaatcttcttgtttgtacgtgccaacgtcacgtccattccacgctcgaactcaccagatacgatacgcacaaaggcgatacgatcacggtggttagggttcatgttcgcttgaatcttgaacacgaatcctgagaattgctcgttaccaggttccacttggccgccatcaaccgtgtttttagctgaaggtgctggtgcgaattgcatgtacgtttgcaagaacgtttcaattccgaacccttgcaaggctgaaccgaagaagactggtgtcaactcaccgttcataaccgcttgctcatcgaattggtttcccgcatccttcaacatctcgatttcgtcgcgtgtctcagcccaaagtgggttgtcttgcaacttgtttggttctgccaaatcagtgccagcttcgttcaaaggcaagaaacgggctgcttctgattctggacggaacacttcgacattgttgtgatacaagtcaaacaatccggccaaaatttgtcctgatccgattggccaattcattgggtaggcgttgattcccaacgttgactccaattcatcaaccaagtccaaggcatcgcgaccatcacggtccaacttgttgaagaatgtgaaaattggaatgtgacgttcactaacaatttcgaacaacttcttcgtttgtggctcaataccctttgcagagtcgaccaccatgataactgagtcaacagccatcaacgtacggtatgtgtcttcagagaagtcttcgtgtcctggggtgtccaagatattgatgcgcttaccgtcaaaatcaaattgcaaaacagatgatgttacggaaattccacgcttttgctcaatttccatccagtctgactttgcaaagtttcccttacgtcccttaaccgttccagcttcacgaacaacaccaccaagcttcaacaattgctcagtgatcgtcgtcttaccggcgtcggggtgggaaataatcgcaaacgtgcggcgcgtttgcatttcctcttgtaatgatgccatttttatcgccttaatttcttaatttatttagtgattctttaaaaatcttaacaatttagtataacgaaaaaacggctatgattcaacaccacaaccgttcttatatacattgtattttaattgattattgctttgtccaacccatttgttgcgcgatttgatccatcgttaacccaccgcgggcgtcgatgtagttattcattgctgcttgaatttcagttgatgacaaattagccacgtcgtagcctagtgctgcccattcgccgcgagccgtcgcaatgtctttcgagtcaatttgacgttcaggcgaagctgagtcactagacgatgattggctgcttgatgtcacgctcgatgaagttgttgccgaatgtgcggtcgcaactgatgatgaataagctgcctttgatgccgccgttgccgcttctgcaactgatgccgccgcctctgaggaagccttcgccttcgatgaaaccgccgcgtgcttaaccgaatcacgcttgagcttaatctcttgcatcgcaaccttgacgttcttattcacgattttaattgcgccgtcaaccgtcgttgctgacttgtacaatgacaatgcttcttgccagtcgctcttatcagcctttttgtcggcagaaatcgcaaaatccaattgttccagcgccgtacgtgcctcaactgaaaccttttgcttttgtgacgccttatagaattggcgtgctgactcccaatcttgttgcttcaaagcggcatgcgcatttcgaatatccgaactgtattgcttgtccttactcatcgtttgataaccgaaaacaccagccgcaaacgctacaatcagtactaccacgattacaattatctttttcataactatccccttgtttatgccctcattataaaggaaaagcaatgtccctgggtagtccaggtgacattgcttttaaaaaacatattgcgactaacgatcactgcgacgcttgatttccaagtatctgcgataccacaagtcgatgtactcgtccgaaaatgggccctgatgcttattgatccaatcaactaggattttaacatgctcctttacgataaaatcaatatccgctgggtaatgccattgtgccttgtgcaattcatactcgtccgtatcaagcaagcgcttttcaccatctggaaagacctttacgtccaaatcataatccacgtacttcaaagcttctttatctaaaacaaacggagaagctaaattacaataataagacaccccattatctcgtatcatcgcgacgatgttgaaccaatacttacgatgaaaatacacaattgcgggttcacgcgtcacccaacgacgaccgtcatcttcggtcaccaaggtatggtcattcaacccaataattgcattttcactcgtcttaagaaccatcgtgtcacgccaagttcggtgcaaactgccgtcatgcttgtagctcttgatcgtaataaagtcgccctcccgaggtagtcgactatctttcattatctgagcccctttacggcttttcaccaaattattcttttttattgtatcacgctactacctataacgcactgccgttttggactcagactatattattgaatgtttatgcacctcattcgcgcgttcgttatgcaaaactctgtatattgttacgagttttgttcgaattcctttatccacttatccacaagagacaagtcatatcccttgcgaaaaagagctgccttcagccgttttttaaattcccagccttcatattgacgataccggttaactgctgaactagcgtcccgattcagattttcccattcttgattggggtcttcttcaatcgatgctccataagctttcagtgcttgattaactaaacgactgtcgtagccaagttgtgacaacttttgtttggtcttttgttcagccatgaaatgtgactgacgatggtacttaatcatcaacttttcaactttttcatcgagctgatcaatttggtcctcagccgtgtactcagctaacgcatcctcaataaagtatttatcaattccaatctgttgcaacttcgtcttaacgccccgtggtccaagcttcccagaatggatagcactacgaacgtactcctcagcaaaacgcgcatcatcaatgacattggctgcttccagtcgattgataaccttagcaatcactgcccccggaatctctgattccttcaacttaataataacttgcattttagaacgcatacggcctgtggcataaactaacgccttggtataggccttttgctcaaactcagccgcctcaatttcttttatatcttcatcttctagctcggtatctttgaacaaattatatttaatcaagattttttcatctacagccaaagcaaattcatcatctaaataaacgttataacgtcctggcttccgctgacgggttacttttgtcacttttttcatgtgcggattctcctgaagttagtttgttttttctggttaacgcaagcgctcaaattaagtttaacctaaaatcgcaaaaagagccaacgcaaattgcgtcgactctttcgtatcgttctgttagataaatgatgacatacctgggttcaattcaacaatcttacccgtacgcttgtagataatccactcagcgatgtccgtcacgtaatctgacgtacgcttcaagtaaccagcaacaaccaagtagtcagttgaggcggtaaccaattctggatctgacttcatagcatcgattgccatctcacggatttcacctgtgacgtctgatactgacatggcaacttgcgcaatggcttcagctgacacagcatcgtcattcacgtagtaatccaaaacatcagaaaccatcttcgcaactgttgagccagtcatacctaccttctcttcaatggcagccacacgcttgttacccttcacgtgaattgttgaaagcgcaatgttacgtgcgttgtcaccgattcgctccaaaactgaaacggccttcaacaccgtcacaatttcacgcaaatcagtcgtcactggttggtacaaagcaatcatctcgaaagtcttcttttccaaagctatttcgcgttggttgattgccttatcaccatcaataatctcttgcgcagcttggcgattgtgatccaagaatgcttgtacagcgttttctagcgtctcagaaacgagcaagcccatctccttaaatgacgtgtccaagtctgcaagttcttcatcaaaatattgacgcatgacctatctccccgtttttctgttaattcgttaattcagtatatcacaagactatccgaagcgacctgagatgtagtcttgggtttccttcttagcaggatccaagaacatcttctttgtatcgtcagcttcaatcaagtcaccattcataaagaacgccgtgcggtctgagatacgtgatgcttgtgccattgagtgcgttacgataatcatcgtcaacttatcacgcaattgcatcaacgtgttttcaaccgcgtgagctgaaactgggtccaaagccgccgttggttcgtccaacaacaagatttctggtgaagtagccaaagcacgggcgattgacacacgttgttgttgtccacctgatagtgacaacgctgacttgtgcaagtcatccttcacttcattccagatagcggcttgcttcaatgacgtttccaccatctcatccaaaacagccttgttcttctcacctgaaatgcgcaacccaaaggcaacattgtcataaattgagaatgggaatgggtttggttgttggaacaccataccgatgtccttacgcaattcaaccgtatcagttgatggcgcgtagatatcttggcccttgaacaagaacgtaccattaaccgtcacattgtccgtcaaatcgtgcatacgattcaaggcacgcaagtacgttgactttccagaaccagaaggtccaatcaatgctgtaatcccgtacttatcgtaatccagattaataccgtgcaacgcttccttttcaccgtagtagaggcgcacgttttcagttgtcaaaattttttctgccatttgcgttatcctctcttaaccaaagtttccgttcacgtaatcgattgtcaattggacctttggacgtgtgaaaatcttacgtgtcaaatcgtattcaacaaccttacccatgttgaagaaggctgtgtaatctgagatacgcgctgcttgttgcatgttgtgcgtcacgataataatcgtgtacttttccttcaactgcatcaacgtatcttcaatcttagctgatgaaattgggtccaaagctgatgatggttcgtccatcaacaagatgtctgggttcatcgcaattgcacgtgcaataaccaaacgttgttgttgtccacctgatagtgacaatgctgacttattcaagtcatccttcacttcatcccacaaagcagcttgcttcaatgacgtctcaacaatttcatcaagttgcgtcttgtcacgcatgccgtgttgcttcaaagcaaacgtgatgttgtcataaattgacttagcaaatgggtttggacgttggaacaccatcccgatgtgcttacgcatttcgtagacgtcaacgtcctttgagttaatatcaacatcacggtacatgatgtttcccttaactgttgccacatcgtcgttcatacgatttagtgaacgcaagaacgttgactttcctgatccagaagcaccaatcaatgacgtaatcttgtagcgttcaaacttcaaatcagcgtcttgcaaggccagcttatcaccgtagaagacttgcaagtccttcgttgagagtgcaacctcatgcttctcttcgtccatatcgtagacgtagcgctctggttgctcctcatcaaaaatcaaatgttgctcttcagccatgacaatgtcctctttcttacttcgtagccgtcaaacgcttgtacaacacaccactcaagtagcgagcaaagaagttgaacaacaagacagcaatgatcaaaacagctgatgcaccagcagaaactgcagccgcatctggcatgataccttctgaattaaccttccaaatgtgaacagccaatgtttcggctggacgcataatgttcaatggacttgaaacgttgaatgggttccaatccgtaaagtccaatgctggggctgattgtccggccgtgtaaatcaaagcggcagcttcaccgaacacacgtccagctgacaaaacaacaccagtcacgattgatggcaacgcagctggcaaaataacgtgaccaactgtttcccaacgtgacaatcccaacgcagcacccgcctcacgttgcaagtccggaatcgtgcgcaatgactcttcaaccgaacgcgttagcaatggcaagttgaagaacgtcaatgaaatcgcacctgacaaaattgagaagccaatcttaaattgcacaacgaacaacaagaaaccaaacaaaccaaccacaactgatggcaatgatgacaaaatttcaatggccgtgcgaatcaaagacgtcacacgactcttcttgttagcatattcgttcaagtagattcccgctcccaaggcaattgggaatgagataatcatcgtaataatcaacaagtacaatgaattaaatagttgaataccaattccaccaccggcagtaaaggccgtcgctggtgatgtcaaaaagtgccatgacaagtgtggaacaccttggtacaagatgtaacccaacaaggcagccaaaatcaaaataacgaagccggcaattgcataaagcaccgcactggcaatcttattcgcttgcttagcgttcatattacatggctcccttcttagcaatagcacggataaccgagttgaagaccaatgacatcaacaatagaatcaatgccaaactccacaaagcgttgttttcaagtgatcccataaccgtgtttccgataccttgtgtcaaaacagacgtcaacgtagcggctggtgatgtcaaattctgtggcatcaatgcggcgttaccaacaaccatttgtacggccaaagcttcaccgaaggcacgtgccattccgaagacaacggctgtcaaaatacctggcgttgcagcacgcaagataaccttataaatcatttgccaacgcgttgctcccaaagccaatgatgactcgcggtagtgacgtggcactgacttcaacgtatcaaccgtcattgatgttaccgttggcaaaatcatgacaaacagcaccatcgcaccagctaggattccaaatcctgagccaccaaataggtgacgcatcactggcacaattactgacaacccaataaatccataaacaacagatgggataccaaccaacaattcagtaactggtcccaaaatcttagccccacgctttggtgagatttccgtcataaagacggctgttccaatggcaaatggtgttgcaatcaaagctgaaatcaacgttaccaagaatgatccaacaatcattggggctgccccaacgtaagggtgaccattcgcatctgtttgacctggcgcccacttggtaccagtcaagaaatcccaaatatttactttattagcgaagaacgttgccaaaccctttgaagcaacgaaccagaaaattgatagcacaacaacgacaatcagcaacaaagcgccgagtgacaagtaacgaccaaaacggtccttacgtgttgctgctgattgctttaatagtgattcacggatgtcatccatgttcccacactccttaatttacagctgtaatctttccgtccatcgaacgagagatcttcatatcgtgaattgaaatgtatcccaattggggaaccaacgtcttttggatgtgctcagaattaatgtaattcaagaatgattgcacttccttatttggcttacccttcgtgtagatgtgttcgtatgaccaaattggccacttaccagtcttcactgtcgtgtcattagccgcaacaccatccaacgttggcactgaaactgtgtcgtccaagtaggcaaaggctgcatatgaaacagctcctggcgttgttgaaacaattgaacgcaccatacctgaagaatcttgttcttgagcatctgctgattcagcacccttcaagccccacttttcaaacgtggcacgcgttccagaccccgcaacacggttaaccaaaacgattggcaagtcagcaccgccaacttgcttccaattcgtgaccttctttgtgaagatgtcgatcaattgattttgtgtcaaattcgtaatgtttgcttctttattaatcattggggcgataccaacaacggcaaccttgtggtcaaccaacttgtcagcatcgataccattcttctcttccgcgaacatgtcagagtttccaaggtcaacggctccttgttgaacttgtgccaatccggtaccagttccaccaccttgaacgttaacgaaaactcccatgttcttgccggcgtaatcttctccggcggcttcaacaagtggttgcaatgcggttgatccaacagccgtgatattcacgccactgtttgtttcgcgcgatgcgtatccccaagtcaataggcctcccgcaaccaagacgattgcggcacttatcaaccaactgcgcttcataacgaacgcctcctaatatcttctgctactagaattattatccctaatctatgtaaatgtcgcaccacttttttgtaaaggtttcctttacattaagtatatattttcaattctacgcttcgaatacttattctactacttataagcttttccaaatagtcgtgtatttttggcgtcggcagacaatctcatgtgtttgtgtcttaacggtcattgtacgtgtcggccgtactcgcattttaccagctgccacttcaaaatctaagcgaagagcctcagcaccgaccaacgaaaaacaccattgtcccagaatgggtttagcaggtgtgccctgcaagacaaattggtcgttactgaggtagccaccagacagccatttcagtaacccgctaatgcgatgtggtccattcccgtccggaactgactgatagaaatcacccgtcatatctgttggcgctgcgtgtaacagtcgtgagaaatccgactcagatagcgtttggcgacagcgatataatgtccagcgagcatttctcaaccacccaaattccttcgtcgcattaagctgaaattgctcccaaaattcacgccaacgcgcctggttttgattcgccaacacatcaaaacgacagcgcgattccgtcaaaaaaaattggacgaccgttaatggacgtccattgattggtttatgcgtaatcagcccctgttcatcagtcacctgcaccaacccattcgtctcgatgtaatcaacatcagtcgccggcacacataatcgcatcgtggccgtaccagtgatggttaagcgacgggcgattggacgtccagtctcaaattcacgtaacacacacatgctaaccgacaaccagtcaccattggttaactgatgttcataacttgttaaatgacaaccccaccgcatatcctcgactgccagccagatttcacctggcgccggcttaatcaagaggcgctcctgaccaaccaacaatgtccaaccacatgccaagtcaggcccgtcagcaatggaaatcgcattacctgtacgtcgcgtccaaaccgcgtcttctagtaaatccttttgcgattggccagcgattgccaccgataagttcagtcgtaccatccaggcgtggggacacacttccgttaccagtcgccaaataacgcgattctgttccttcaaaccttcattgacgataatgacttgttcaatctccgcttcatggcacaaccactcagtcaccgctagataggttgcttgtaacgattgtgtttgccacgaaaacaccttttgacgaccagctttaatttcagttggtgtcattttaaaacggattgttttcatggcttggctacctcaacaaaacggcaggcatcccccacataaatggttttctgaacttgaataattgccgagcatcgatcaaacaacactgcttgttgaataaacaccgctgaccctggcgcaatttttaacacttcagcctgtgctgcagtcgccacgcctaagacaatatgtcgaaccgcatgactggtttgaatgccaaagcgacaataaaagcgttcaattgatgtcgcatccaccaaatcacttagcttcggtgcatatttcggcattacaaaatgttcttctaaggccatcggtcgatcgttcagtagctttaacaccccaatgtgaatcgttggcaagctcgcccggtctagttttagaatgtgcattaaatccactggtatctgtccctcttcaaccaaacacaatttagacgtcagcgccgcattatgggtcattttccattctgatagttgctttaattcgcaaactggcacagcaaaaacttgtcgttcggcaacatgcgccaccttgccctttttccggataatcaagccatccttttctaataatcgtaatgaccgtcgaatcgtctcacgcccacattcatagtgagtccccaactctgattcgctcggcaacggcatgccactttgatacgttccgttgcgaatctgcatttgcagctcttcataaatctcttcgaacacatacttcctcatagtaaaaagtcccccacaccgcagattatacggtaatgggggactatgttctagacaaggtgttaactgttaacacctgctctattattgattaatacttagccaaagagtctaaaatcaaggcaacaaacttgtcgttatcaagcgttgtcatcaattcagcgttggctggcttgccagtcatatcgtgttggtcaactaccaaacgaccacgcgtcaattgaccttgtgtttccgcatcaacgtagtatgccttaccagcaaacattgatgggtcaatcaagtacgcaaccacttcagggtcattcaaaacaaccggtacatctgggttgctgaagtcaccatagttttccatcaaatcagccgcagcttgagccactgggttttcgattgcacgcatcttcgcaactgtctcagatgaaatcacaccttgctcagtcaagtcacgtgtaatcattaccactggcacaccgctgttcacgataatcttggccgcgtcgggatcgattgagaagttgtattcaacacctgggtaacggttacccgtattaattgccccacccatcaacacaatcttttcaatcttgctgtgcaattctgggtgtgccgccaacaacaaagccacgttcgtcacgggaccactgataccaatgaccattggttcgtcagcttcacgcaacgtcttagccatcaagtcgataccagctagttctgagggctcgaagccgggctctgggaattctgtcccgtccaagcctgtaaactcacgccagttatcagcaagaccgaatggctcaatcaaaggcttcgctgcaccgtgggccactggaatatccgtgcgtcccaaaagtgtcaacgccttcatggcattcttttgtacgttttcaactgtttgataagcaacggttgttgaaaccgccttgatttccaccttgtccgtgttcgccaacgccaacatcaagccgaagaaatcttcgtgacctgggtcacagtccaaaatcatcttaatcattatgtcgtcctcgttttaggcaaagtgttggatgtgtggaccttgctccttaaagccagcgtccaagatttccaattgtgtcaagatttgctcgtcagtaacttccttttcagcaccgtgcaaaatcacatccacacagttttggtacatcaaaccgtagttaccacgtggcgtctccatcttgtgctcaaccggatcaccgtaagcgttgatgtacttaatcactccgtagttgtctgggttgtcagcaccaaagttaggctctgatggtgagataccagccaaaatatcgttttcttgggcatccataccgtacttaatgaatgaaccattcgtaccgtgcaagatgtacttaggatattggtcagccaccaagaagcttgtcttcaactttgcacgcaacttgccgtagtacatgttaacttcaaagttatcgtcaacaccttcagggttcgtcactgacttaatgtcgtacgcaaccgcttctggcttaccccacaacttgatgatttggtccaatgggtggacaccgtaaccgtagaaggcaccatcaatttgcgtacctgggtttgaagcagcccctggacggaagtagtcgaagtgtgactcgaactcgattggctcaccaatgaaaccgtggtccaagatgtattgcaactccatgaactcaccatcgaaacggcggttttggaatggcgtaatcaacaatcccttttcgttagccaatgcaatcaattccttaccctcggcaactgatgtcacaaatggcttttcaaccatcacgttcttaccggcttccaacaaacgctttgccaattcaaagtgtgaaggtgctggtgtgataacagagacaaattggatttctgaatcattaaccacttgatccaaatcatccgtgaagacaattccacgtacttccaaagcagcttgatcttcaggtcgcttgttcaaagacggcgtgtaaatcgtcttaatttgaacgttttcattttccaacaaataaggcaagtggtaacggtttgcactgttaccgaagccaaccaaggccataaccaacttttctgacatatcaatactcctaaaagatactttattgctcattaattaacaaagttcattgtaagcggttgcagttttgtgtgcaagcgatttcacaatttgttcaaaaagaatttttgatggtgtgcattcggcaccaaataacaaaaaggcaatagcctcactgtgccattaccctttgatgttttgttactatttacttcttgtatgcccacttccagtcgaattgtgcgccaactgggttcgtgacaaccttcttaactgaaggacgtgacaacgttgctaatgaacggtagtacaaaggcaccacgccggcatccttttcaattgcttgttcagcagtcttgtaatcgtcgtaacgcttgttttcgtcagttacatcagtcgttgaagctgccttcacagcgttatcgtaatccgcgtttgaccagcttccgttgttaaacgttgattctgatgtgaacagatccaagaatgttgaaggttctgcgtaatcagctccccatgctgagataaccacgtcaaagttcttgtcctctgacaatgccaaacgttgcttgaatggcaccgtcttgattgaaaccttcaaacctgacaagttttgtaattgtgattgcaagaattgtgctgtacgctttgcgccgtctgtgtcatcggtcaagacttgcaagttcaacttcttcttgccctcttccttcaatccttcagcaaacaacttctttgccttagccttatcgtatgaaatagcaccctttacggcagctgactttgcgaagtccttgccagtatttggatccttggccaagttagctggcgtcaacgttgttgctggcgttgccgttcctgtcaaaatcttgtctgacatcgtcttacgatcgatgacgtatgacaaggcttgacgaatcttgacattcttcaaagcggcaaccttcttctcgttcaactcaagatagaacgttgttgcttgtgggataaccttgtacgccttgttcttctttgaggcacgtacttggtcaggtgacaaattggtaaagtcaatcttaccagacttgtacaagttataacccgtgttttgatccttaatcgtttggatacttacctttggtgtcttaacagtcttagcatcccaataattgtcattctttaccaatgagtacttgttgtttgagccagtccatcccttttgaacgtatggtccagatgccaacgtgtactttgaagcagttccgtacttgcttccaaccttctccacgaacttttggttttgtggatagaatggcgccatcgtcaaaattgattcaagttgtggcattggcttatccaacgtcacttccaacgttgtatcatcaacggccttgacacccaggtcattcaagtccttgtccttacctgattggatatcatcggcacccttaatacctgagaacaagtatgcatattgtgatgctgtcttaggatcattcgtacgttgccaaccatatacgaagtcttgggcggtgattggttcaccattcgcccacttcaagtctggacgcaacttaaacgtatatgtcaaaccatcatctgacttttgtactgattcagccaaagccaattcaggctttgaatcttgactataacggtacaatccttcgccggtagcttgcaaagcgtcaaagtcaactgaagccgttacctttgatggatccatcgttcccaagtcagatgtttcttgccagttgattgtcttatacgttgctgcgtttgctgccaatggcgcaactgctgatcccaaaatcactgcagtcgacaacagcactgatgtctttaccaatttgttcatatcccgtattcccctgtttcttgcacttttagtatgtggattaatataaactaagaaaaaagaagtgtcaatgccatttttctctaatgttaataaacctaacatcacaaatgccgtaaacgcccgtgtttgggcgtttcaaaaattagaaagttttaattttaatttagggaacagtcagaatgcacaaaaaaagcgagcaattatgctcgctttttaatcagattaaatgtcccaatcgtccaatgaatcaacttcatgggttggttgttgtgcttcttgggcaacttgctccttcgtagaaacaccggtgtaaaccaacaacgtatcaatgccagcattcaagccggcgcggatatccgtgttgtaattgtcaccaaccataacaacctggtcagccgtcaatcctgttagttccaaagcaccgttcataataatggtctctggcttaccaacaacgactggatccttttgaacagcggtacgcaatgcagcgacaagcgtgccggcacctggcaacataccacgctcgttaggcaagttcgtatcaacgttcgtcgcaacaaatgcggccccgttttgaatggccaacgttgcttggaccaacttttcatagttgatttcgcggtccaaaccaattgcaacagcatcagctggggcctcactaacaagctcaaaaccctttgcttccaaagctgtacgcaaaccaatttcaccaatcatcaacacacgcttaacgtttggcaaagtcgccaaataatcagcggttgccattgcacttgtgtagacttggtcagccgtcgttggaatgtcgtgattcttagttagattctcggcaacttcggctggtgtcttcgttgagttatttgtgacaaacaaatattgcgaatcagacgcagcaaggcgctcgatgaaacgcttaccagccgggaactgcttggttccttggtaaatagtgccatctaagtcaataaaatatcctgcgtatgtcatcaattaatttccttatcccttttcagtcgttgtttggcgctcacggatttggaaacggcgacgcttcttacgtcccttcgtttcaaccgtgtttgcgcgttcctttacatgcttagctttcccgttacccggtgctggcttagttgtctcagcaatcgctgccgtctttggctttggcttgtggtgtccaccagtcgcgttgctgttactgttaccattgccagttgaacgacgttgacgacgacgcttacggtgtgccgtgtttggctcttcctcagcttcgggtacatcatgtggctcaagattttcaagcacaaagtacggtgcaccaaagtttacttcttcatataagtagtcttgtagtgcagaaatttgattgcttcgtgcaataccagctgtgccgtccttgtaaaagccacgcaaacgaagctgatcagccgcgatgtcaccaaccagaaaatcatacttttctaggaagtcgctaaatcgtgccgccattttttgctgattgtaagcttcacgataatcttcaaccaaacggtaactacgctcattaatgaaaatgatattatcgtcacctgccgtaatggtcgtggcttcttgtcgctttataaattgctcttcagcaagttctttcatgcgttcgcgatccatgttttgcctccttcctaattaattttcttctttatttggtaaaaacgtttcggcaagatatgccgcaaagtcctctcgaattactgtatcatatgacatcacgttctgtcccgctatttccaaagttgggaagtacggaataaacaagtaatgatccagtgaaccaattgtatatgtcgcgtctaaatcaatcggttggtcatgaataaacacatccccattcgcatcgatgcggaggccagaccaaaccacttcaccccaggtatcaccacggaagcccataccgcgtaaccggttagggcggaggaagttacgattcttctcgatttcatgagccaagcgccataaatcatggcccttcaatgttgaacgcatggggtgaaccgcgtgtggtagcaaggcatgtaaatcattggccgttacaataccagctggcaaatccgtcaaaaacaaacccgttgagagcatcgcaacatccgtgtgtgtgcgtgccttcaacgcttcaagaccaaggtcaataaggcggtgctcgccttgcaatccgttggtgtaagctgttggcaattcagcaaccacgcgcttggccagttgctgttcaccactcgtttgataacccgcgatttcaacgcggtcttccggcaacgtcggcaactcgtccgtcacaaccgtcgtcgcttcgacagccgatagatggccatcttcaactgttaaatcgatgcgaccgatatgatcaccataacgtcctgcggcagctagcatcgtgtcgccgtgtcgttcgccattcaccaacaagtggtgcgtgtgcgcgccgataatcacgttcagatcaggataatgcgttgctaaataacgatccgttggcaaccccaaatgtgataacaacacaataaaatcaacttggtcagttaattctggtatctgtcgatcaagggcgtcagtgaccttttcgggcatccagcccaacaaaggtaaggtcaaaataaacggtgctgtcaaaccaagcacgccaacgcgcgttccctttggtgtggtgataattttatgtgtcaccgcccagtcaggcacttcacccgtttgcatgtccgtcacgttacctaatacaaccgaaaaattagcatggtcatagagatgattcatatcatcatgagccaagcctagtccttcgttattgccaattgtgaccgcatcataaccaatctcatttaataaggcgacattggcttgccccattgtcgcttccgtcaatgggtgttggcggtccaatgcatccccgatatcaaaggtcaacacactgcgtccttcacgaattaaatgacgcttttgtgtttgtaaataacggcgaatttgtggccagtgctccagatgcgagtggatgtcgttcgtatgcaaaattgaaatgttatcctgcatacgttttacctccgctttgcaaaatcatcgtgcttacgttgaatgatggtctcaatctcattgaaattgagtggcgtactccagaccggccgctcatctgccattaagtaatccaagtccgtactatcaaccccaacgttaatgttttctggaattgccaccatcgtgtggtgaatgtgtccgtgcaagttaatactacttggcgtttgaccgaacaacattggatagtgcgtcaagaagaattggtggtggttcgccttaataatgcgaccaacatcctcaaactcatacttaggcttgccatcagacaacaccggattgtgggccgccaagtacttgaacaacgcgcgtgaatcgtggtttcccttaataatcacaatgtgtccgttcaattgttccaaaatttcggcaatcatttcgtgacccttacgtgctgggcgtacatgattaaccatcgcaatatcacccaagtggtacacggtgtcagtttccccaacgcggtcattccaggccttaatcattgcaggatgttcatcggccaaaaagtcgaatggacgtggtgcaaaattgttgctttgcaatagttcctcatggaagaaatgcgtatctgaagtaaaaaattccatttctctcgcctctcaattagcggagtcgaccgccttcgtaactcttaatccacttctcaaataattcaaaatctgccggaaaatcattgtacccaacaaaacgcaactcatctggttgatcggcaaacttaatccgaacaccccactcatcagttttgtcagtcacaaccccacgatattccggttgccaagttggcaaaatttccattagtcgacgttcaatattcggccactggaatgaaacatcttgccacattgatgcaaacgggcgacgcttatcgtcagcctgcacctcatccgcatttgtgcgtgaaaaatcaaacgttgcgtctgtaatatcagcgaacgttttcatttcagctggcacgcgcaaataaaaggcatgttggtcagtctgcttagcataaatgtaatcgaacccagctgctaaatttccgcgataataaacaacgtattctaatgccatattacttatcaatcacaatcaaatctgttggaatacccgccgtcaagttctcaaacccgtcagccgtgacaatcacatcatcttcgatacgtacgccacccttaccagcaacgtaaataccaggctcaatcgtcaacagcatgccttcacgaacaatatcttcggcaggtgaacttgctgacaaaacaggtccttcgtgaatatccaaaccaattccgtgaccagttgagtgattgtattccttaccgtaaccagcttcagtgataatgtcgcgagcaaccttatccaggtcggcatctgcaacacctggctttacagcgtcaattgtggcacgttgcgccttaagcacaacatcgtaaatcgtctttgactcatcatccaattcgccaaacgccaacgtacgcgtgatgtctgatgtgtaaccatccacaaagtagccgaagtcgattgttaccaaatcacccgcttcaattgccttatctgagtacgttccgtgaggcaaagctccacggtaaccagatgcaacaatcgtatcgaatgatggcttatcagcacccttttccttgatgatgcgatcaagcaagttagcaacttgacgttccgtcatgccaatgtgcaattgtggaatcatctcgttgaaagcctcaacagccacttcagctgaacggcgcaacttagccaattcgtcagtatccttcacttcacgaatggcttcaagcaacgctggtactggtgcaatatctacgccaacaaagttttcatccaagtaatcgaagtcacggaatggcaacgtgtcttcaaagcccaagttttcaatcttaaatcgcttggctgctgccatcgcaacaccccagtagtcacgggtaaccaacaattgaacaccctcatctaggcgttcgcggtattcttcttcgtaacgggcatcggtaatcaaagcggcgttttcgcgaccaatcaaaaccaagccatccccagttccgccttcgaagccagtcaagtaacgcatgtttgtgccgttcgcgatgatcaaaccatcaattcccaatggttcgaacaagcgacggacattttcgattcgtgtgttcatgattattttcctcgttttcttaatgcttccattatagcaaatcccacctgtcacggctgataagtgttgtcttttcggttaaatcaaaaaacagtcactcattcacgagcaactgtttgttcttaggctttaaaaatgatgattggcgctgtttgtacggcgtgaattgcctcccaatcaagcgcaacaccgatgccaggttctgttggcactggcaacagtccagcatgtaataccggcgcatccaaaataatatcccgttcaaagtaacggtccgcttgcgaattatcacttggaatactatttgcgcccagtatacttgctagcgccgcatcaacagcgcgacccaggccagaacttagcatgccaccaagccaaggcaatttgccagccgctagcgccagcacgatggctgtttttgcagccgtaatcccaccaattttggcttgcttaatcgtaaaggcatctgccgtttgatcagccaatgcgcgtttcacatcagctaattcatttagtgattcatccaggctgatgtgcatttgtaaacgcgcttgggcttgttggtgtgcctgccagtcatcgattgcaaacggttgttcaatcatgaaaatgccagcagtctcaagttgttgtaaccgtgcaaagtcagccggttgccatgacgcattcgcatcaactgaaaactgctgatgcgggaattggctgataaccgtctttagcatatccaggtcagtttgctgattgattttcaacttaatccggcggtagctttgtgaaacggcatcactaattgacgacagcaacgccgtcggtgagtcagcaatgccgatcgcaatccccaccgcaatctgcgatgccgtaccgtcaatcaattgttgcatcgattggtgcgtcgccttgccataagcatcataaaaggccatttcgagaccagctttagcgaatgacaaagttgactgttcagctaaccagttggctatgtcagcgggtgtcgcaaagtcctcacccagtagcatcggtgccaatcgttcaatttcagtaattgactccgcgtgtgattctgacgcgtaactgtgatcaatgaaagattgcacatccccatacccaatcacgccatcaaccgtcatagcaaccaacgttagtgggcggtcatatgtcacatcatgcgccgttttaaatggttgcttcaatcgcaacatcaacgggcgtagttcgatttgttcaatccgcatcgttagcataccccatcaggatgtctgtgacttcgaccggcttttcaaagtgcacattgtgtccagcgcccgatacggcaacacgtactgcattgggcaacatttcagccatgctgtcattaatcgccgtaaactttgcgtcatcagcaccagtgataagaaccaccggaaactgaaggtttgttagttcaggccaatagtttggcatggccccagtaccaaaaccacgcaatgaatttgcgacattcaccgcagtttggttgacgcgttgttcgtgcataaatgcttgttgttcagcggaagcattttgttggctcgcaaacagtggcaacttttcccaatcggcaacaaaggcagccatgccctcttgctcaattcgattggccttctgttcatcgctcgccacccgcgcttcacgcgctgcttgatcagcgattcctgctgtcccgctctctaagaacaaacgctggaggcgttcaggaaattggtgggcaaaggccaacgccaaacgcgcccccattgaataacccaccaaattaaccttgtcgattcccaacgtatcaaggattgcgacgatatcaagtgcttggttagtggcgtcaaatcgttcgcgcgccacagctggcgtttgaccgccgaaccctagtaagtccaggtaaatccgcgtaccagccggcttaacctgttcgtagtcagctaaacttcccataaagccgtggaaaaatagccacgttggttcgccagcaccttcaattcgtacatgatacggatactcgtttaccagcactagcttatccattgaaagcctcacgaatcttggccaacaatgaatcgtgttcagcaacgttttgcgcacgcgtactttgcacctcaatcaaacgaagtgtcgttgcaggttgcgcaatcaactcacgcaaatcatcttgtgacgtcgccaaatgatactctgcatcataaagggctgcaatcttctcaaccgacaaggccaacggcgtcccgaacattggttcaaagtaatccttcgcagctgcttgtggtaggaatgagaaaatcccaccaccattgttgttcacaaccacaatcgtcatgtccaagttggcttgatgcgccatcattaaaccattcatatcgtggaagagcgtcaaatcacccgtcaagaatgtcgttggcttgccagtcatcgccatcccaaaggctgatgaaactgtcccatcaatcccatttgcgccacggtttgccatcacatgcacctttgtggctggcataaagtaattgtccatgtcacggattggcattgagttggcaataaacacttggctatcagccggtactgctgccaacacgctaggcaaggcaacttcagacatttccgtcgttgcaatcgcttgtgcaagagtttgcttaaccgtttgccattgtaatcgataatcattttcggcacggccagcagttgccaacagctcatcaatcagcgccatctcatcaacagccaaggttgtggttgtttgacgtgagtggtcgtgaccagcatggttaataccgacttgaatgacttgcacttgcttgtcacgtagccaagcgacaacccgggcagaaaccggtgtaccaccaaagcgcactacgacatcaggtacgagtgcatcatcaagcgcacccgcttcaagcaacgcatcgataccattaatggctgcgtcacttgagcgcacgttactcaagacatccgctaacattggcgcttggaagtgttcagccagcgcaacaaacttttcggctatccaccccgtctcatcaggtccaaccaaaattagcgtcttttcatcacgaagcttgttcgcaaccattgcgacagttgtttcgtcagcacgcatcgttcccacggtaatcgtttgttgcgttatcgttggccatgcttcacctaagtcaggcatcaatggcttgcgcaatggcaggttaatttggaccggacctgctggtgcagttgtcgccgtcacaacaagttgttgcacgtgataatcaatatacgccgtcacatcagcgtggtcatcttgcatctgcaacgcactaaatgccttggtgttgtcaccgtacatgttcgcttggttaaccgtttgtggtgccccaattgcttgtagttcttctggtcgatcagttgtcaacgcaatcaatggcacgtgcgaaatgtgtgcttccattatggctggcaagtaattggccgtcgctgttcctgacgttgccaacaaagccaccggttggtgcgttgcctttgccatacctagcgcaaagaaagctgctgagcgttcatcaacatctaccgtcacacgtacatcatcacgaacagcttgcatttcagctagtaacaaagcgaatggcgttgtgcgtgaacctggcgataccacgaagtcatgcacaccttgggcaaccaagctggtcaataaatgtttaatgtttcgcgtcaaaatctcgttcattttgcttgtccttctaataaattcatcataggttgcatcttcaaccctgtctctgcatattcagagtccgcatttgagtcggccaaaataccagcaccagcaaacaagtttgcctgcgtaccagtcgcccacattgaacgaatgccgacaatcatttcgccatcgccatcaggcttcacaacgccgattggaccagcaaatagccctcgtggttggcgttcaatttgcgcaatcgtcgccattgcccagtcaaccggcttgccaccaagtgccggtgttgggtgcaaacgttcagccaacgccaaaacggtgttttcaccacgtagtttaccgtcgattggcgtgtacaaatgttgtacttgcgggttcttcataatttgtggaccatctggcaaagttaagtcagccacgtcacctagtcggtcaacaattgtttcaacaacataggcgtgttcttgcagattcttagcatcatgcaacaattcatctgctaattgtccatcttctgcttcggtctcaccacgacgaatcgtcccagcgaccccggccgtctcaaattgaccacggttcactttagccaagcgttcaggggttgctgaaataaacacctcatccccacgcttgatgaccatgtgataactattaggttgttgatcagctaaatctgccaacaacttggccaaattcaattgaccagaaagcgttacttgtcgttgacgaccaaggacaaccttctggtgagtgtcattttccgtcatgtcttggatggcgttgttcacgcgttctggccaatccgtttcgtctgttgtagctaaaattgcgactggttcttggcgatatggcgcaccaaatggattggtctcgcgtccccacaagtattgatcagtgatgtcatacaacaccgctggcaaaacaaaataaccattcattagttggctatccggtaccgtttggtcatcgaatgcaaatccaccaaagactggatagcgttgttgctttgcccagtctgcgacttcttcgaatgatgccccaattaattcttctgcgataccaaagccataatagcgtgaccgtttatcggccgttgcaaaataaacggcattttcagcttgcgcaaagcggtcgcggagttgtttttcagatggaaaactcatgtctatacctcacttctgttctactagtatatcactcgtttgtaccatacacgggccacattttaaggacgttacaatttatcttgttacacttttaacaaagtccatagtatactatcagtatgcagatttatcgcatcgatttctcacaattaatctcacaacttttgctggtaacccagcatttacctttcaaatcgaacgctgcatattagctcgcttttgccattctcttggcataagcgggctttttcgatacctacaaaaaagagaatgtcgcaacattctcctaccataatctattcaaattgggcatcgtacaacgtcttatacgtgccaccttgcgcaagcaactcatcatgggttccacgctcaacaatttgatcagcattgtgtaccgtactcaaacggtgagcaatcacaatcgttgtcttgtgggtcatcaaattatccaaggcatgttgaataatcttttcagattcgttatccaacgccgccgttgcttcatccaaaatcacaatttcagcatcctttaccagtgcacgcgcaattgataggcgttgcttttgaccgccagacaacttgacaccacgttcaccaacagtcgtgttcatcccgtccggtaagccacgaataaagtccgccaccgctgcacgttcggctgcatcccaaaggcgttcatcactaacacccccagaaccataacgaatgttatccgcaatcgtcccatcaacaatcgtgacatcctgactaacgattgaaatgtgttggcgcaaatttcgaatatcgatatcttcaatcttcatatcatcaaaacgaatctcaccaccagtgcgctcatagaaacgcgtcaacaagcgaatcaaggttgactttccagcacctgaacgaccaaccaacgccgtcgtcttaccagcaggtatcatcaaattaattccgtttaatgatgccacacgctccaaatcataactgaacgtcacgttatccaattcaatccccttctgtaaaggacttgggaacggctgtgggtcatctgaattcttaattgtttcaactgcacccatgatgtccttgatacgatcgtatgacacttgggcggtttgtagcatgttcagcaaacgtgaaaatgaacgaattgggtcttgtagcaacgccaagtaacttaagtaggctaccaattcaccaactgttaaatgtccttggatgaccagcaagccaccaaacgccaaaacaatcgccgttccgatggtattaatgaagttgaccaaaggttggaaaattgcctgccaacgggttgcttcgagttgatacgtattttgttcttcaacaatatccttgaagcgacgcgtctcttcatcttccgtcgtatagctcttaatcaactcaatttcagtaattgtcccttgcagttgatttgaaatttgcgaactcgtcgcacgaaccttggtgtacgcttcacgaatgcgtgcacggaagaagcgaattgtcacaaacaacactgggaacgtgatgctaaccagcaaagccaattgccaatcttgaatgaacaagaacgtcaaaacagccacgaacgtaaaaatattaccaataatgccaaagctatctgaactgatcaagttctgtaggctactgatgtcgctggtcaagcgcaccatcaaatcacccgttttagcactttggaaatcatcataatcttgcttcaaaatgcggttgtacgtctgcaaacgcaggtcggtaatcgaacgctgtgacaacacctgcatcaagtacgttgaaataaacgacacaacgcccagggccaacgttgtgaccaacaatagtgacacttgcacagtcaacgcggaaacacttttcaatgccaccgcatggtcaatcacgcgctgcgtaaattgcggcacgatgaaattcaagcccgcaataataagcagcaacaccatgtttaacactaacaatgacttacgctttaagacgctaccaaaaacgaacttaagcatctcagtcaatgttgtatctgattcttttagataagccttcatttcagaaggactcatccggccacgattcatcatatctcgtcacctccacttcattttctccgacaacaatcataacaccgctgacgaaaagtgagtgcaaaagggttcgcatgaaaaaagccgaacccacgatgagttcggcttttcgtaattattgttgtggctgcaaaacttcaaccattgcaaccgtcgcttccaacggttgcgcctttacgccttgatgttcaagcttaaagacctttggatttgacgcaacttcaatgtagtcacgcatctccaaataccagctagctaagaaatcaaactcaaccaacgtatccaaccatgacgctgcatcatgaccatctacgacttgtaggtgccagatgccttgcatttgcaagatacgaacttcgatgttgtttttgacaaccatcgcagccccgttcgccgtgcgcttcaagtaataaccactgtgcgctgagtgaacgaacaagcgatccaacaagcggtccggcacgtagctcggaatgagttggtaaatatagctatcagctgtttctaaaatgttgtaatcaactgaataacccaacgtttgctccatgtagcgaccaaataccaagagcatcgctgcaatcttgcgaattgccgttgacgcttccttttcgcgcaaatcaacaaccagtaggttagtcaacgcttctgaattaaacaacaattggcgttgttcaggtagccaaaatgccacttgttcaccagtacgttgctcaaccaaataagcaccaccttgtgtccccagaacacatcggaacgtaactggtgtctccaatcccttcacacgcaacgtcaattcttcactgtcttcagacatcaaaattgtgtatgcatctgacttggcaaattccataaaacgattcatcgccaacatgtaaatgtcagccaaaccatactgacgtggcacctgtacccacttatcatcaagcaatcgttggttcaatgccaacagcaaaccatgcacctgggctggcacgtttgattctgacaaatcgtgcacgttagtaatcattgtttgaacacggtcaaggtccgcttgcaagtgtgccgtgtaccccgttacacggtcatgtaattccctaagcatgttatgttacttccctttactctttttagctgttggcttggttgtttctacggcaccagccaatgacttcacatagtctgcatatagtgactctgcctttgcagcaaacgtctcaaagtcaccgaaagtttcttcaatagcgtgttgttcatacgccaagacagactcttccttttcaagcgccaacaattgttcttcgttcttagcgattaacattggcaagtcagcagccttcttatcagttgcatccaatgcatctaacttaacttgcaattcagctaactcatcaccgtttcgcttgaacaagcccttcttgttttcgagctcagtctttttctcttccaactcagcgcgttccttatcacgatcaggttggccagcaaccgtttcgcgcatacccgtcaaaagacgttcgatttcagcacgctcagttgcgtggacggtttcttcagtctttgacaattcaactgactgcttcaataattcaaaggcagccttgttgaaaatgaacgtgactgaaaacggatcaagcacaccaaattcacgacggtcccaccagtcaccaaagaacaagtggaataccccaacttccgtttcttcatagaagaagaatgggaacttctctgacaaataagcaatcaaattcttagcaacatggtggctaatcttaggacgcaaatcatccacaagtgcagccaacacacgattgttatccgcaccagctgcatcatgcaccgtcatgttgtaacgccgtgcatcaatcatctcaaaaatttgacgatcatccccagccataatcgcttcttcaaacttggtcaaaaaggcttgcttcttttgcaaatcgccttgtagttcgtcggccaagttgccagtctctgtcttataatatggcgtttcttccatgacccctcatctccgtttttctcgtttttgttaattacaattttaccataggaattcctgattataacggacggtattgtatataaaaacacgcgaaccaatactgattcgcgtgtttagggttataaatatatttttataacttcagggcacgcttctgggacacggtataaccgtgttcaccaataatggcgttcaaacgttctacagttgtcgaaacattgttcacatatgcccccaagaaatatactgacgaatcatctaggttattaaagtctttatccatcagttccactttctcatttgcttcattcaagtactcaacatcctttgatgttagattaatcatttccgcaatctcttggttaatgactttttgagtctttgtttgtgccacgatttctgcagctttctgatttgcttcgctagcaattttcttgttttttccattcataaacaaaccaccgccaacaagagccgctcctccaattgcccatccaattggtcctgcaagcgccaaaaaggcttctccaccggctacgcctgctccaccagcagctagcgcaccaccacctaaccatgccaacgcagcgtttgttgccgcaataccagatagaccactaatcgccgctccagtggatgctacaccaaaagtggtcgcaattcccattgctacagcaggccccaaggcggctacgccaacacccatagcaactcctcctgccatggctccaccggctttcatatcaacatttgcagcatctgctttagccgcctctaggattcgagtgtaatttttcatagacaccttaattttttcaatcttggtatcaatctcaatcggtgtgttcttcaattgattgattagatcaatactgtgttgaatttgttcttgtgaccgaacacgaacagtatataattcctcagagtgcttcgttgtgtcctttacaaccgcattcatttcatcggctttcttttgcaaattagctatcgccgctttcttaacatcgctgttaaacataaatcatctctccttatgaattgaaaaaatttacaatatcttgtttgtttttaagaatcctgttgttatccacacctgatgcttcagcataatcaattgaatttttgaattgatcaactgagggtagactgaaatcaaacgctaaatctgataaagcgttcatttctgcataataatcaactgtgtcagctagtatttgttggtatagctcatctacttttgttattgcaacatcatatgccttctttatagattttgctgaatgctccaacccgaacataatggtgtttgcaaccgcctgcatttcttgcattgcttcatcaaaatgatcgacaaaataaactgtaattaccgtcaacatcgtagttgaaagcaatccgacaccagcacccacaaatcctgctattgttgctggtacaccagcagcttcaagcccgttctttactccctcttccagcatgatacctaatgctacagaaataccactcaatgaaattttgataaatgatttaattttatcttccgtagataagttttctggattatagataagaactttaattccttcaattaagctagacacacccgtttgaatcaatttggctacattcttaaatgtcgtaataaacgagtttatcaatgcagtaatcaacgcaccaattacacccgatgccattccttgcgtaaaattgccaaaaatttttaacaaaaactcttttatatgagacagacggtatttaagcttttcgcctaccctctttagaagttgtttgaaatgctcaaccttatcatccaatgttttgtattgcccgaagcgtcgcatgtagacctgaaaatcttccacaaataactcttgaaactcaagaattatcacacccacagcctggcgctttgcttcaacaaagccttgcgctccggcgccttcagcaatttctttcatatgcgcaccaaagactgttttattaatttctttttcagactttttttgcttttttagagcttttcctttgtctacgccaaaacgttcttcgttagtttgcccgtttttggttttctgcagccaatcatctaatttttgttcacccttagactggttcagactaccatttataggcgccatattatcaggactcgtcgccatatcattgcgctgatcatccgtcatatataaacgggcagcgtcattatcatggatatgctttgctgaagttatatggtctatgtgcgttgacttgtctttagacaaaatctgctcttatgctagatttacggacagatttttctctgccctgtaaactaatagtagaggagcattttttatatgattcgatattcaccagaatttaagcaatctcttgtcgagatgcacaaccaagggcgttcttgtgctcttaccgtttcccggcacaccttgcagcactacaaacttattaaacggctcatacgatctataaaacatatatccaatatattcagttaagaattgggcactatcaccaaccatatatttaacaagcgcgttaatggtcttaggttctttgccactggtgtctagcggataatcgaaaccacccaaaatgtaatcatttttattatgtggttgtaacgtgtccgttctaacgttgtatgtgccgttctccaacgaaacaagccacggtttttcattcgtgaaaatgtcacgactcttaaaaatatcgttgataacccaatttgtaactgccttagagtttgcggtggtatatagtccctcactcgccagcttcatgttggcaagtttaaaaatacgtgtatttagttcctctttatttacaagccgttcccaatacttaccattaaaatacgctccgttcagtagtgaaggtgttcttagaaaaggaaagtcagtcgttatttcatcacctaatttaacggcatctaacgttttccgccccttatcatcaatattcacccaaattggatggttgctattcgcttgtaccgcttgttcgtcttccggcgttattacgcttcttaaatcagccattcactcccccttaatagttccaattacgtgcccaactcttaaactttttcgttaattcctcaaacgcaatcggatcattaccggtattgttgacataatcaataacatcagccgtaaattgtaagttgccatgcgtattcttaaatacccaaccaccaacgccagttagcatgttgtcccatcccccaaactccgtgtaatagtgttccgggtcgataattgccgaaatcatcaggcgattattatcagcccatgccggcctattatcaaatgctatttgtcgcctctttggggatgactttgattgcttaggttcatatcgatttgggttctcgtcaaatatcttgacgaactcatcaaccggcaatgctaccgtgtcgcttgcgttaataagaggctcactgtgcgcgttttgcgttgttaatacatatgtaccagccaactgcttaaactgccttgttgcccctgcttcgtccgctgtgacgtacagtaaataactcaccactcgccacaccttgatatagtcatctggtggtgctggtcgactcagttcgataccaatacgcatccgtgcaccggacttaataccgttgctgatggttggataagcaactagaccgtactgttttaacaagccggcagttatcctatctctcacttcgttatacgtggcttcgttaccatccacatccaaaaacaagatggtacgggctgtcacttcactatctgcccggtctgttccgtcagcaagaccatataccgcatacggtgcccgcgttcgtttgaaagcgtccaactgttccggtgtcatgttctctgcagttgctgggtgctccgttgtgtatacgagatgctgaaagtcagtgccaccattcacaacttggtattctttggccaacacgcccatttgtgtataaatcatctctttttcctcagtttcaaaacgcgtgtacggccgttttctacatcttcttcaagaagatcggcaatcttaggcaaatcatcacttgtatattgtttatcattagaaaaactatttaaaaaaataagcaagtcatctccatatccaaaagcgccactcacataagcgttttcaattaaaaatgccgcttcctcgtacttatcaaaatcggtatattcacgcaccttaataaaaattgctatttgatctgtcgccttctcgggtgtcaggtattccttgccgaactcatcaacttcagtcataatgtatggaaatctccttttttgagagtgctcacggcatcggtcgggaaacttcagccgcgagcgaggttacaaagcaactacgcgtgttcaatcgaacgcctgtggctgctttttttgttgtcgttgaaattgttacgccacgtatgcaaatcaattgaccgcaacttttcagcgcgcttcaattcctccaatgcttgggccgtgagtggggcaatcgcattgtttcgttcttcatcactggtaatcaggtagtaaccactcggcgcgctgcgtcggctaccaattggcacacccttatggttaatcaggaacgccacccatgccgtgattgtgcgcttgttggtatttagtcgtgtcgcaatttcagagatgcttacgggcttctctgcgccttctggtaacattgccaccaactgctcaagctgttccgttaatgtttcttcactcatctgtatcaactcctttcaaatcacccaacttcgcgtttatcacttcaagtacatgtttcttcgtgtactgggttagatctgtttctgtaatggcttgtgcagctgctgatactgccaacatgaaacctaattcaaagtctgaactcgtctttggcttatccaattcacgcaataaactgcgtacattgcttgtcaccatatatggcaactcatcagccgttgtggcactaataagcgcctgcaaggtcaaagccaccccacttgttgcaataacggctagttgactgtgcccgccttccttaatcaaatcattcacatcacttgccaccagtttaattgtggcgttgtctagtcctttcatctcatcgcctccctataatcgctttatagcttcgtccagttccgattgatgaaacaattcccgtgctacaccaaattcaaacagtgaatgtggcttaatcacgcctttatctatcaatttttgaaaggtcttaggcgacacatccaaatagttataagccttaatcttagataaccacgggcttttctctggcgccgttatcgctgccgttagccggtctagtgccgccactaagctctcgttatctggtatactggtagcattcataaataaaaccgtgtcctttcttttgggtgcgtggtaacgattagtaacgggctttggtcggcacaggttactagtcgttttttctttgtgttgagttggctgctcgcattcggtttatttttgataaacacaaagactttccactgggcagttttaggacttgcttgggtcacattatgtaaaccagccaccacatacaaggtgctggcacggtaataactaataaagttgtcctttaattagtttgttgtgtatgtatgacgccaccagtgagccgtgtgtgcttgtcctgtggcgtctgcgtttagttgttttcgttaaactctcggtctgccttggcacgtttcaagccgtcttgaaccttctcggccaattcagccaatacatcatttgcttcatgcttgtcatctgcatcgatggcaccgttcaacttctcggttaattcaaacaagttaaacggatcgtgtgcagcgctatgtgggtctgcataagtacgggaaatttcttccatgtacttaacgtgtgttagcgccttctcaatgtctttactctcaatcgccttatatagctttccagttgtgtcatatagccccattgggtcattaggttgttgactagtagccggtgctaaatcaaacgttgccacgctccccatatccttggccaactcttcaatagccattgttaggcggacccatgcatccgttaccattgggcttcgctcgactgtctcaacggcatcaccttccaccgtttccatatctactgcgtgcattgccgccaacaattcggatacagtccccactaaatcgtacttatcaggtacattgaccgttacaggtacataccgttccgtttgtagtgctgggtgcttcttcgccgtgtagtcatacttattcataatcaaaaccatccttctttggtattggggatgcatccccatgcgttaatatttactgtggcagttttcagacttgccaaggtcacatcgttaatcgtctacttcttcaatcaccaatgcgcccatatataaatcaattagaatgcacgcgatgacgtaaataatagaaataccagcaagaatgccaagtagttgtaacaagaatgtttgtgtgtctgtcatgctagcgcttccttaacttcctcgtaactcttaccaattagcaacaatgctttaatagcttctctaacatgctctaggtctgatacctgttccgctgttagcgcgtctttagcgtctgatacaccaaactctgctttaagttgcttagcattcttgcccgtgacaacttttaacgctaagttatggatcgttgcgtacatatgcggattatctggccaactgtcatggaccacttcactaagtgacttattcactggcttaatgttggcaagggcaattgtcttatgtgctagttcctcacgttgtgaataaaacgcggcaaccaaatttcttttgaactcaacaaccgtatccgtgttacgcatcaatgcgataagaaaagttgcttgttgctcgttgtagtgccaaactttccgtgtctgtccgcttggtaaagacgaatttttaaaaaccagctttccaaacttccctaattcatcgtgatacttgttagttaggtgtcggacgtgttcaacagatacatccgtatacttcgccacaatttcacttgttgtataaacaccttctgctggtgtgccgtacattactaaatcttccatggtataattaccttccttatagttatctgacaccacggcctgctcgctgtggtgttttttgttgtgcttgacattatcagaccaccttgtaaagccattgatttaatttgtctaccgtacttggtcgcatcgcgtctttttcgccttttagcaacttatctaaggtccaacggctaacccccgtttgtcgcgatagctcaataaccgaaatattttgctcgcctcgcttgcgctttaatgctgtcagcatttcatttgatactttcatacaccctccgtactacaaatgtgcaaatgaaaccaaaaataaaattgcacatttgtgcaactggtattccatagtatatgggcgtatttgttgattgtcaactacatttgtgcaattatagttccatagataaaaaggaatatataaaatcatggaaaaagacacaaaacaaacgccactaacaaacttgaaaaaattaagacaccagtccggtgagactttaaaacaactaagtaatgatactggcatctcttactctgccttaagtgcttatgaacgcggcgtccgtaaaccaaaatatgaacaactagaaacgttagccaaccactttaacgtcagcattgcatacctaaaaggcgaaagcccttataaattgaacgaatttttcccagacggcatagataacagcgagataatcagcagtatcaataatgacttcattcacgacgcaaatatttttgaaagaatactggatgtgttcgagtacagcgacgcttatattgggttaaactatgcacgtactaagggactagatttatctgacgttgataaggtggacatcgttcatatgattagaaacatattttcattgactgttggcgaggcacttagtggtaactacaatacgttaaaaaccatacaaaaggcgctggggttggacctaagcaaagaacaactcgataaaatgaccgaagaagaatataaaaacattttcaaacctcttgagctaaataactggtttgaacaaaattcggaagagataagcgactacttaaaacaaaaccccgccaaccaaagatcatattattctatgtgggatgtgaaagaagcatatagccaaacaaatgaaaataactcgcatactaatcacgagtaatttaacctctatatttctcaataattagcaggcattgctaatcaggggtctgcgcaatattgcgccaaccaaatgggggttcgttaattttgacgataccctaaaaattgaggtataccgaaaagtcggccaccccctcacatactcaaaacttaatgccatacatagagttggctgctcgcatggaaaggcttaactatgagtattacgaaacaaaaaaacggtacctactccgtgcgcatccgttggacggacaaacagggtaagcgccgtgaaaaaactaaaactaaatttgaaactaaaacgctagccaagcattgggaacggcaagcaacattggatgctgatgccggtaaatttgacggtgtcacgactgacttaaccgttaatgaacttgttgatatgtatctgcaagaatacgtgcgcggtaaaaggctatcaaccacaagcaaggtggcccgctcatttgaaatgtacgtactcacgcctaaatggttcgataacgttaaagtggctaaactatccaaagttgaattacaacgctgggttaattggttagctggccagttctcatcgtacaaacgcaaagtggatcacttcagaaaagcattagatattgctgtatcttatgaactgctagaaagtaacccgcttaatgacgttcgataccctacggcagtgtcaaagcctgataggtcatatcgagttgaattttacgatcgccagcaacttcaatcattcatgcaagctgtacaagacaagtatgataatgctatcaactatcacaagtacgcctatctccgtttgttagcatttacgggaatgcgcaatggtgaggttcgtgcgcttgaatggtctgatattcatttagatggcaatgagccacatattatcgttagcaagaccactagcgaaacaactggccatggtgtcgttattaacccacctaaaacaaaggcgggcaatcgcaaggttatgctagacaaaaaaaacgcgggcatcctaagacactggcgggctattcaaggacagcaaatgatgaaacgtggtatatctgccaatggcattgtttggaccaaccagcgacttgataatcgcatttcaggcaatcaaccacgttcgtggctactatcagccatacgtgatacggacgtccctcaaattaacattcacgggttacggcacacatatatcacacttgcagttcaagctggcatggatattaagactttgcagtcacaagttggacacgatgacgtaaaaactaccttagcaatttatgctaccgtcacagatgaaatgcgatcaaagacggccgatattttcactcaattagtcagcttttaatgacaactgggggagtaactgggggagtgaatagaattcaatactgaaaacgcctacacgacaagggtttcaagctgattggtcggttcccagccagagcagtcagtaatttcgcatgtagcgccggttccatttggaaccggcgctatttgtttgcgtccatataaaaaaagatgcgtatcgctacgcatctcaattcattatttattgtcgacgttggcggtatgacatgccgccactaattagtaacaacatgcctggtacgacccaaaacatcatgacaccacttccgcccacacgggggaagattgattgttcatgaggtgagtgcacctttatatgccatttgccatcaactttttgtggctgcgcagcttctggtagtggcgctgtaccaactggcgccccttccgctgtcgacacaaccccatcttgtgtgacttcaaaataataaactgttttatccgccgcatagccatttggagccgtcaactcattgatgcggtacaccccacgtttcaactttggcaattctcgtccatctaacggaattgggcagtagtattccttattggacgtactagtcaccatatatgtcgcaccagcagttggcgtaaagttctcgccaaccaacttttgcaagcggacagacgtcggctcattcaccaaacgccacatgcaaccgctatccgtatgtggcaccaaatcaccatcaacctgagctgtatgattctcaatgacaatttcgtgttcagtttgatcacgccagtacatattagccgcaccagtttgacgcaacttgtacttgccatctggcaagtttagccatgtgactgacttaccattcaaatcttcattcgcctcaacgacattgcctgtagcatccgttagttcaaacgttgccccactcaacgcctcgccatcaggtccgacattgtgaataccaaatttgtgcgtcatcacgtttgccgtttcatcactttcaccgcgacgatagtgaacgactgggttcgaggtactcttacgattcaaatccgtatcgtcatagttataagccactgtcgccttgttttcatatgaatgcgtgtactgcaaatcgtcgatggcatgcttgaccttcaaaccaatcgcccatgtctcaccattgaaaatcattgccgatgccccggcggttgtgaatgtaattgtcaccacttggtgtccgtcagcgtttttagacatccaaacacgatagtccacaaactcacggagcaaacgacgatcgtcattttcgttcgtaccatacacctttacaacatcaggcatattgccttcgcccacatcgtatgggaaatccaacgtcatccgatcagtctcaccattcacggtactcattggcaatgtatcttcaacgacgatccctgttggcgcaatcaagaaatcttgtcgattatcataggtgtctggatacaaccaataccaaagcgatgtttggtcatccggtaactcctgattcgacaaattattattaccgtctggcatttcaggtccgaaacggtcaatcgtcgctgcgcctaaatcggctgcgtaaccaaaattccgatcagccggcacatccaacttactcgtcataaagctatgccaaaccccattcgtattggaaccaagactgattgtaccgaacgtcccatctaggccaaatgacaaagctgaacgttcaaagccagccccgcctaatcgatctgtccaaacagtatcgtcactaccaatgtacttcgttccaaacctagccaccgatgtatcatcgacgacagttgctaaattagtcttgttgcgatcacccgtcacccagccaactgactcagcataagaacgccagccatcaccccagttaccatacggattactgtacttatggtcattcaatgaagctagtgtcagactagagcgcgcttctttttcatttgtcacatcgattacgcactgcggaccgtcttctttggccgtcacaaattcaaacttcacgtgaaaatccgccaacttgttgtagaccaagccggaatagagattattcgataagtacaaaaacggcgcaacgttgtcaccttcaccacctgatgcaccacccagcgttccaggcatgaaatctgatagcgtcacatacgcccccattttgtgttgaacccattttccgttttccttggtgctatacgtacccacataaggataatagacggtcaactcagcatcgcgcgcagcggcctcatcaaaatcaactaccgaaaccatcaccccataattcttaccgggtgcttcttcgttcaattggtcaaaataataaagtcctttttcaacatttttatcatcgagcccccaaagattggcaatcgattttttactggtcgcgttataccgttcctcaataaacaaatacttatcgtttacggccgtgcgattgagatatatttgcatgtcatccgcattagagtaggcatccggatcaatcttggtcttatatcctttcaccgttgcgtttggcaccaaatcagccggcttcaacaacgtttcacgctcagcctgcgtttcataaatatcgagttgcttaccgttgcctaacgcatcacggttatcttgttccgtcgcgaacttctcataaataatcccggtatcaattcgttgcgcttcccaatgattgttttgctgttcttcaaacagaataattagcatgcgggcaaatgttttgtcttccggtagattaaatgagatgtcgactgtttgcttgcctgatgttaagtcaatacgagcaaaatcattgctgtcgagacataactctttcccattaattgttttactcacgatatcaccaacacggtcgtgagtattaaacatcaccaacatgctgtcggcagcatcttcttctggtgtaaacgtgactttatagtcaaaatacgcacgacgttgcttgaccgttgcactaatcgcaacccccttaaagaaggtgttaatatttccacccgttgtcttcatgtcgttcaagaaaacaatcccgccgccattatttccctcttccgttgcttcttcatcaccagttaattctgggtctaactcttcttggtacacgccctctaacgttccaccaagcgcggttacaaccttgtcagaaccagtctctgttgctctaacggtgcgtgcaaatgcaaccgtcattagcggttcgattgcaactgcaactggcaaaaccaatgcgacaaccatcaacaaaacaaatattcgatttaatagtcgtcgcattgcaagcacctcccaaaatattacctatcctatattacggactagatacaacctgtctgtggctgtcaattaaagactcttggaaattctcgatgggtttatgaccaaaaatgcaacagaaaagccggctgcgaacatttctgttcacaaccggctcattcaagcaaatttaattttcaaatatgtgtatcaaaattattggttttgacgacgcttgatgtaccaagctgccccaccggcgatcaacataataatcacaccagcaccaatgtatgcttgaattcctgttcctccaacacgagggaagattgacttagcatcgttttgaacgtagaagctacccgtaaacacaggcacatcttcagtaccctctttagctggcaaccacttaattgggtttccgcttgcatcaacctgtaagaatgatacagctttgcttgaatcaaagtccgttgtgtctggcacgttagtatacgtgccatattgtgcttgtggcactactcggaagtagaagtaaccaggcattgcataaccacttggcgactttttctcatcaactgcgtaaaccttattataatctagataaactggatttttgttagcgtcagggaacaaagtgaaatatcccttaccattgtcatccatgtcagtccaagctgaggtaagctcgtgtgtcttcacatcatactctgcatacctaaactcagcaccctcaagttcattcttgtccgcatcaatcttataaagttcaaagttcactaatttttgatcattaattaccggaccaacccaagaaggattatccgtgaattcaccatcattttcgaggttccattgattaataataccttgtgagtatgtgtcatcaggatcggccttaatctctcggataatgctttcgtcttcaacttcaaactcaccagtcacatagaaaataacatcttgagtcagacccgtatatccgcctggcgtgttcgtttcaatcagacgatattttccaactttcaagccattccaagtaaaggctgaactaccagaaatatgacttagtgtaatgtcttccggattgccggtcatatcagaccaaccagtccaagttgaaccattccatgcaattggcgctccaattcgttgcaatttgaacatagcattttgcagcttgttacccttgttatccatcttagtgatttgcaaactagcttcaggctcaggagtaatatgaaccggcaccatgtttgtagtgattggattaccctttgtcaaagcagtttctacatttgcagtattttcgaaatcatgatcagtctcatcgtcatctgtcacaagcgcactgaccttaacatccaaatcaagagcgatgtttccgccatcgaatacagcagccttcaatccagcctctgtaaatgttacaacgatttgttgcttaccatttacggtactaattgaaactttgtaatcagtattaggaatgaaagttccaccattcgtgttgtaaacaacgattgactttgacgacgttgcagacgttccaaggtcaacatcttctagtgtcacatccgtatccaacgtgtctgaaatcacaagttcagccggcttaaccaatgagtacgtacctgtgtcatacgttggttgcatcacccagtaatcgtatgtgaagtacggatcaccattaattagagtcgttgatgtcaacgcaaggttgtcgttgtataaatcaccataaccaacacccaaatccttcattacggtagttgtcaatgctttaccgacttcgttttcacgttgtacatagaaatttgtatcaaacttctcgcctgtttctgcccaggcagtagtgaagttcttgcgagtttcactaattatatctgctgcagctgtgtcagccgccttcaattctgagtttgctttttggtaagctgtttgcgtatcaccagatccgatattgtcacgagtgaccaacttacgaggagcattaagttgcattggcttattgttggcacaagtcaacgtttgccaagtgttaccagtacccgtaaacatacggaagctttgtgccgttccgctagtcgtatacgctactgatcccattgggaacgtgtcagtatcatcgatgttatcttcccagtttccttgaacagtagtcgttgtttcccaatcataattaccgtgagctgttgaataccactttttgttaacatcatctcgaatcatggcagacccttcttctgctccaccaggtccaacgacttgtccattcgtccaaacttcttcgttaattgtgccaccaagtgcatttagtggtgaaaccgtctcagcccagattgatgttgagatacccgtttgatttacattccaatgtggagaattagcagatgtatcattccacgttgttgaactaccagctccgaagttattcaaagaattgaaagtgaacagagaatcagaatccgtcaaatctagtagactagtaaacttacgagttgatgaatcaactgcgtagaatcggatttccatgtccagtgattcaataccgtgatacataacccctgaataaatgttgttaggcaaatcaatataacgtacagaacccatcttgtcgtgagaagggtcaactgagacaacattcgtaatagttaccgctgctcccatttcatgaacgtcaccatacgtatcaacataatacccaacgttgtcataaaatagttggaactttgccttctgcatgacagcaggatcaatattgctagaaaattcaatattgtatgccgattgattattagtacccgtaccagatgtcaaatattgattgtgatacttagttcgataagcttgccctggaccataattcgtcaccgatccaccaatatctgctacagatgcatcaaatttttggtaaatattaattgacgtctgtccattattgggatcaccacttttgtggtacgtcgtatttgtagcatcactactccaaatttggaagttattaccatccgtattggtaccattcttaactggcgtcgtacgatcgtctgaatcaatcacggctagttgcacttggtcatcttcatcaagtgtggcgtctaaagcctcaatcggactagtagcaccaccttttgtaataaacccgtcgtctgatccatcgataacacgatgtgccttctcaccttgcttatcttcagacttcttttcttccttagcaactgcttcagtcaccgtctcagaagatgaagattccttagcaatttcagcaaccttctcaaacgccatcgtcaaatcgactgagcgattatcaactggcagcttattttcaccattcttatcgtcatatagtcccaactcagtaaccggcaacgtaatatcgtgcttatcttcattagtactaatggctgtcaaaatcaaatgtgtactttgtgacttcaacaccgcactcacgataccctcgcgcatgtctaatgtcttatcatcttgcttgatttcagcgtcctttaggcccgccttatccaaatcaagtttgaacttaaccgtctgctcactgacagacgtctctgatcgatcaaactccaaatcccacgtggtctttgtcttgtcctgtgatgtcttcaatttgacattcagcaactcgctctcatacacgttctgcggtccagtgaccgcatgaatcgcgtctcccaaggtacccagattggcggcaaatggcacagccagagctgccaaaccaatcaaagcgcctaacttgcggtgacgcttcttaattgaaaagcctccactttttgtcatagacgtactccctaaatctgtattttttctctcataaacagtgtggtccatcccaccttctgttggactatctcagaataccgataaaatggtgtaacagtttggcgcaggcgtaacgacttttcgaaacgttatgaagaaactttgccacttgccttgaagtttgaattttccattacagaatggcgtcaattcacaatttattcatttttattccacgatttcacccttatttactttttataatgaataaatgtaagaggggctaacgcaacttctcacctagagaatacacaaaagacgtcgaccggcataactgctagtcgacgtcttttatttataacttattcaaataccatttggttgttgtacaactcagcgtagaagccgccttgcgccaacaactccgcgtggctaccgtgttcgataacgtttccgtcacgcaacacgacaatcttatcggcattcaaaatcgtcttcaaacggtgggcaatcacgaaacttgtacgtcccgcaatcacgttatccatcgccttttgaatcttagcttccgtcaccgtatcaacgtttgacgtggcttcgtccaagatcaacaagtcaggcgctgtcaaaatcgtacgggcgattgacaacaattgcttttgaccagttgagaagactgaattttcatcagacacttgggtatcataaccatcttccaacgtcatgatgaagtcgtgaatgttggcttgcttagccgcatcaatcatttcctcatccgttgcatctggcttaccgaacgtgatattgtcacgaatcgtacccgtgaacaagacagaatcttgcaacacgataccgacgttatcacgcaaagacttcaagtccatgtcgcgcacatcaacaccgtcaaacttaacggcaccgtccgtcacatcatagaagcggttcaacaaattcataaccgttgtcttacctgaaccagttggtccaaccaaggccaccatttgacccttgtccacttcaatgttgataccgtgcaaaatctcgcgatcagggttgtaaccgaagtgtacgtcatccaacaaaatcttatccttaacgccggtgaacttcacaccgtccttagggttgatttcgtcatcttgcgcaaacacttcgttcaaacggtgggcaccagtcatggccaattgcaacatgttgtacgttgacgtgatttgtgtgattggttggtagtattgttgtgagaacgaaacgaacgtcacaatcaatcccaaaccagccgcacgtgaagccaagtcaccgttcaaagcttgtgtggcaccgtagaaaatcacgatagccaagttgaacaaacccattccttgcatcaatgggaacaacacacctgaccaggtttgaccaagcgtcgtggccttacgcaccttgttgttgtgctcgatgaagccacgaattgactcttcttgcaaaccattggtgataatcaccttttcaccattgatttgctcgttgatgtatccgttcaagtgcccaacttcagcttgttgcgcatccacgtacttcttcgcttgcacaatgatcaaagcagccaagataacggcaacgggcgttgacgcaatcgtcacccacgccatcttagggctttcattgaacatcatacaaaccacaccaatcaacatcgcaatttgtgagaacaattggaaaatggcttggttcatcgcgttgaagatgttatccaagtcagacgtgaaacgtgacaagatttcaccgtcttggtgagaatcaaagtaacgcaccgtcatacgttgcatcttaccaaacaagcccttacgcatgtcattaactgagttagatgacacgatagcttgaatgaaagcgttgatgaacaaaccagttagcatcaacagcacaaagccgaagaataacagcaaggcatggtggaagtcatgcaaacttgcttggctggccgtcattgggttcaacttcaccatcaagtactttgacaattccgtaattgaacgtcccatgtaaactggcgccttaacttgcgcccacgttgcgaaaatcgtgaacacgaggatggcaatcatccccatccagtaacgcttgaagtagtgcgcaaagaaacgaattgattcagtaatattcttcatcttttatgcctcctgcgccttttgtgtcttgtaaatctcttggtagataggtgacgtctcaacaaggtccttgtgggcaccttccgcaaccaattcaccatcttccagaaccaaaatacggtcagcgttaatcactgaagaaatcttttccgcaatgataaaggtcgtcgtatcttgcaaatcatgatcaagggcttccttaaccaacttttctgactttgcgtccaatgcagacgttgaatcatccaaaatcaaaatcttagggtcgccaattacaccacgggcaattgacaaacgttgcttttgaccaccagagaagtttgatgagcgctcttcaaccacgtgttcatacgtgtcttcgtaacgctcaacgaattcagcggcttgcgcgatttgcgccgcacgcttcatgtcggcttcttgggcatccgccttaccttggcgcaagttgtcagagatctttcctgagaacaacgtggcgcgttgcaaaacgaatgagactgtcttacgcaatgatgattcgttggtatccttcaaatcaacaccaccgaccttaaccgttccctcggttgggtcaaacaaacgtggaatcaattgggccatcgttgacttacctgaaccggtcgccccgacaattccaatcatttcaccaggttgcaccgcaaatgaaatgtgcttcaacgttggcttatcatctccagggtacgtgaatgacacatcgtcaaattcaaccgcaccagacaaatcttgttctgggacatccttgtattgcaaatctggttccgtattcataatttcttgaatacgacccatagaaacaaatccacgcgccgcaaatgtcatcatcattccaccaataatgatagattgcatgatgatcatcaagtagttcgtaaatcctgtgatttgagccaacatctttggctcagaaccaaccatgtttccaacaaagtagatggccacaaccatcaaaccttggccaataaacatgaaggcaggcacgataattgagaacaagtacccaatttgcaagttaaccccgttcaattcgtcagaaacttcattgaatcgcttttgttcgttatcttcttggttaaatgacttaaccacacggacaccttgcaagttttctttcgccttggcgttaacgcggtcaatcaacccttggatcataccgaagcgcttacccatgtttcccatgacaaccgctgacacagcaccgaccaagatgaccatcacgacgataacccaccacaaagcaggaattgagtgaacggccaaaatgaaaccaccaacaaacaaaatcggcatacgcaacaatagttgtagacccatcatcaaaatactttgaatttgcgtaatgtcgttcgtcaaacgaaccaccaagttaccaacagagtattgctcgatgtttccaaatgagaacgtttgaatcttgcggtaagccgcttcacgaacatctgaagcgattccttgtgaggcacgggccgcaaaaatcgtgttaataattccagcaatcaacccgataccagcaattaccaatagcttcaaaccaatttggttaaccttgtccatgttatcgtctgagatagcttgaacgatgttggttagcaacgttggctgtagcaacattgaaatcgccatgatggtcaccgtcaaaacggcaatcgtcaaatcgagtttgtaacccttaaagtagggcttcaacaatcgcataatttcccctccaaatttcttatttatttctattcgtcaataggctattttagcagacttgcaaccccttttgtaaattaagtttacaaagaattaaacaaaagccacacccgaaaattcggatatggctttaaaaatcttacttaacaaacaacgtggcaatcgccaaaatgattgaaacaccaagcacaagtgctgaaatcgcgatgtgcaaacgacggtgcatgttcaagacagcaatgtattcacgaataaaggctggaatacggtagtagaacggcgtcttgccaccacgaccttgtgcttcaatgccaaactcacgggcttgcaagccagcacggaagacgtgatattcactcgtaaagaattcgaatgatggttcaaccacgcccgtttccttactaatcaagtcacgtgagaaacgcatgttttcacgcgtcgtgcgactttgatcttccaaacgcgtttactcggctggataaccaaacgtttcaaccgcgtaatcgcgcatggcttgtgcttcagaaaccttctcgtcgccaccttggccacctgagaacacgataactgggtacttgccgtccttttcgaaacgacgcttacccgcatcggttgcagcttgaatacggttagccaacaacttaccaaccttgtggccatcaatcaacccagcgcccaagaccacatagtagtcactctcacgcttgcgcatcacccaaccgtaaacgattgctgatacgaagaaaatcaagaagaccaacatgaagtaaagtgtcatcacgcgggcagctgtgaacaacgtatccagccaagctggcgcattgttcatgataccatcaacaatgttgaacacagccaaagccaagaacaccaatggcaacaacaaatttgccaaggtgtgcgattccttacgccaaattttccatgagtagtaaaccacgccaaggtcaataaagattgacgcaatgacgaaaataccaataatcatcaagacaatgccagccaacacaagcaagccagggccacccaagaagctagcggcaagcatgaccgtaatcaacaagaagaacaagaacaccaatgtccacgttccaagccacattgagcgtggctcattcttggtattacgccaaatcatataaccggctaatacggtaattaataatgaaagtaatgtcagtgggaccattcgtgggctccttaatcaacaatatattttgcaaaacgcgcagcttgcactggcgtcaacgtcacatccatcatcgtgccagcttcaacataatcgatgctgtgaacagatgcttcttcattcaactcgtttaccaattgaccttggtcaaatggaatcaacacctttacttcttggtgatccgcaaagatgtgttcacgaataacgttgaccaacaagtccaatgaggcatcatcttgcgctgacaacgtcaacgtatcaccttcacggtcagggaatgacaaaccttcaatcttatcggccttgttgtaaatcgtaatcattggaatatcaccaacaccgatttccttcaacgtacgggccgtcgttgacatcatttccttgtagttttcatccgcatagtcgaccacttgtagcaacaagtcagcttgcgcagcttcagccaacgttgcgcggaaggctgccaccaaaccgtgaggcaactttgacacgaatccaaccgtatcagacaacaagaagctttggttatcaggcaagttcaacttgcgcactgatgtctccaacgtcgcaaacaacatgtcggcttggaaaacagtcttctcttggttctcaccaaattgacgcaccaaaccgttcatgaacgttgacttaccagcgttagtatacccaaccaatgccacgttcttgatgctttgcttatcacgacgggcgcgacgcgtttgatcgtcagcttcaacatccttcaattcagcacgcaacaatgaaatttggtgctcgatgtgacgacggttcatttccaacttcgtttcaccagcaccacggctagtaaagctaccaccgccaccaccagtttgctggtcaagacgcacgttcattgacgtacgcaaacgtggcaattggtattgcaattgcgcaatggcaacttgcaactttgccacacgcgtcttagcacgtgatgcgaagatgtccaaaatcaacgccgtacgatccatgatgccggcgcccgtacctgattccaagttacggatttgtgagggtgacaactcatcgtttgtcacaaccatgtcagcttcgtagtattcaacggcttcctttagttcttcaaccttacccttaccgaagtacgtggccgcgttcggacgttccaacttttgggtcaccgttccaaccacttccatgtagtttgcttcggccaagttggccaattcgatcatctcgtaatcgaattcagcattttgcttatctagccccgcaaggacgaccttgcggattggatgcaaatcattttctatcataaattatctttcctaccaattagttgtcgtatcgttgtacgccttcaacttcatgtcgtcatctgagacttcccaaactgaaattgaaccattcaatggcttttccttagccgtctcgtgtgagtcgtacttataaaccaagtttcgaatcattgttccgtgggcaacgaccaaaacgttttgtccatcgcgtgtgttttgacgcaaaatgtccaaaccattctcagcgcgggcccagaacgtggccgcatcctcggcgtcatgtgttggatcagcttccttaaacgcatccatcacttcgtcttgcgtcaattgtgacatcaaatcaccgtatgacgtgatgttttccaagccaataatacccgcaatttgctcggcacttgatgcgctaggaagcccttcgaagaaaccgaagaattgctcacggaattgttgcaattgctcaggcgtcttcaaatcaccactttgcgtgttacgccccaaaataaattcagctgtatgaatagcacgttgcaagtcagatgagtaagccgcatcaaagcgcacgttgcttaaacgctcaccggccgcaaacccgtctgaaatacccttatcagtcaaaggtgcgtttccccacccttgcatacgttgatatttattaaagtaagtttccccgtgacgtactagatacaaattaaatgacattgttaacctctttctggttgtgcttgtccccgataatcaggcatcaacagccttctaattgttactattgtaccatttttgttacagtcaccgcaggcatcaaggaattactaataatttgaaattagtttacgaaaaagtgttgactttagtgtgggttatctgtatagttatgtattgttgttaagacaacagatgataattttggcccaatggtcaagtggttaagacgtcgcgttctcagcgcggaacccagggttcgattccctgttgggctattaagctcaggcttgctaaatttatcatcatggcccaatggtcaagtggttaagacgtcgcgttctcagcgcggaatccagggttcgattccctgttgggctatcacttaaggcacggaagtcgtttgacttccgtgtttttttattttctcataacaaataaagcggtgaccagataactgatcaccgcttttttcaactctattttagacttcacgacgcttaaacagcgtcaacgcaatgccataaagcacaccactgtaaacgattgtgaccaaaccgactagccaggcactcatctgatactcagccatcacatcaggcaatcctgccagtgcgctcacgtaaaaggcacccagcggtgaataatcgagtggcaaaataccgtgtccaacgattgccgccccaatcacttcgaacatcaaaatcatcaagataccgataactacgactaacaagtcatttcgaatcaggttagcaatcacaagcatcacactaacaaacagaatcgaactgatgacgctaccaaataagtaacctgcatagccacctaaatcgattaaccacgcctgaccgaacaacaatgagacgattaccattgtgacaaacaacgtggcttgcaacagcacaaatgcgactgcaactgtcaccagcttcgccacgaaaatctgtcggcgcgtaaagcgttgcgcaaacaacatattcatcgtaccaaacgtgaattcagacgtgattacgcgaccagtaatgccaagtaacatcaaatcagtcactagcgccaacgttcctgtgaattcttgattaaccaacgttctcactgtttcggaatggccaatcgcattcgcaagcgccaataataacccaaggacaactattgtcagttgcatcacccaagtggatgtcttcttgaaaaacttctgcaattccaacttaatcaacatcaccgactccttgttgtttgcgacgcgcaatcacatccgcaaacatttcttctaagtccggatccaccttaccgtcagcggctgtcagaatttcatcacgcgaaatgatttccccacgatcgataaagatataatcatcaactaggccttccaaatcacggacggtgtgtgaagaaatcaaaatcgttttgccagcatcgcgccagtcacgcaacactgccttaactgcttcagcgctaactggatccatcccattcaatggttcatcaagcaacaagaggtctggatcattagccatcgccaacgccaccccaacgcgttgcttcatcccccacgaataggtcttcacttttttattaataaactcaactaagccaagttgcgtcacaatctcggtaattttattatcagatataccagcgacttccgcatacaacttcaagttatcccagcctgtcacatacgcatacaggcccggattttcaatcaacgccccgacattggccagcgcatgtcggcgttgcatcgtgaccgtttcaccggccaccttaacctcaccaacatccggttcagtcacgccagtaattaccttcattgttgttgacttaccagcgccattcggaccgaccaacccaataattgcgccacatgcgactgaaaacgatacatcacgcaaagcccgtacacgaccgaatgacttattaatattcgaaacctgtaaaatcggcgtttccataatgcatctcctcctatccgcaactattaatcatacaactcaactagaccccttgcaaagaaattgtcacattccggtcaaatatgtaatctgacaggcaccccatttttcgatacaatggaatcaaacagaaaagaaggataggtgtctgaaatgaagttcatctcatggaatattgatagcgttaacgcggccgttgaacataaatcagcccgtggcgaaatgacttggcaagttttgcaagatatcgcggctgagcaaccggacgtacttgcaatccaagaaacaaagttgaagccaactggtttaacaaagaagcaggcggctgcgctggatgaacttttcccaggctaccaccgctaccttcgtatgagcactggtcgctcaggttactctggtaccatgatgctctcaaagactgaaccaatcgccgttgaaatgcccgaaatcggcgctcctggcgacatggatatcgaagggcgtattattacccttgaattcccagacgtttacgtatcaacagtttatacgccaaattcaggtagtgaattggctcgcctagatgagcgtcaagcctgggatgatgcctaccgcgcatatgtgtctggtttggatgccaagaagcccgttatcttctctggtgacttcaacgtcgcccaccaagaaatcgacttgaagaacccaaagacgaaccacaagagcgccggctttaccgatgaagaacgtacgaagtttagcgctttgttggacgccggctttaccgatgttttccgtcacttgaaccctgacctagccggtgtttatacctggtgggcacaaatttctaagacatcaaagattaacaattctggttggcgtatcgattactacctcacttcaacgcgtttgaacgatcaattggctaacttcagcgtcatcgacaccggtgcgcgccaagaccacgccccaatcaagttggaaatgaccgacgattttgaattataagcaaatagcgcacctgaaaaataaatttcaggtgcgctattttttagtcattatcaatcaacgttggcgtcagcacttcaacgtatcctcgtaatgtgccatctggatttgcataaatcgagaatccgacctcaatcggtcccgctgcatgatgtgtttgcgccgtcatcaagccaatcttgtgtgatgccccttgttgggcttcggtcgtatcatcgtacccagctggctggccgtcatcaccaaattgcttcaccaaatcggccgccaacaactgcaactgcttttcgctcgtcaaatccgccagggtccaaacattacttgatgaccccggcacattaccaaaggtcaagttatccttccgatcaacactgcttccgtaatcaaccgccgtaatgtgctgaatcgtcgaaccgtcaccattcgtctcctcagacccttggctgtagtacttcaacttgccatcagccatcttaaacgttggcaacgtctggaacaggttattgaaattaccgtgcggatctgtcgcaaaatcatcctgattctgcaatgcccaacgactttcttgcttcgccaaattcaacgccactgaagacgccgcaaccggactaacatcgtaatgcgcacgatagctattcaatgcatcaagcgcataatcttgtagtgaatccaatgtccggtcagtcaacacttgtcccggttgattacttgccaaatcagcttgctcgttatgaaccgaagaagaccccggtgcacgatccaacttgtacgtaatcgtctgtgacttcttaacggtcaacgtatcgccacgcgacatccgataaccgtcttgtgaaaatgacggaataatcaactttgccccgtaggtcgcatcataagttttcgttgccacgaggtcattgttgtctgcgtccacataacgcaacgtgactgaatatgtttcagggacatatttaaatgtaattaagtataacttttgatggtctgcgtaattgattcaggcgttgaataacctggaatatcaatcggcaccaacgtttgttgctcaccaggacgaatacttgcattaccctgcggcgcaatttctttcccggtacgcacatcgacatacttgatcacgacaccactttgactgatgccgctggtaaagccactaacgattccgtcgccaccatcaacggcgagtccccccaacgccaatgatagtccgaccaatccggccacttgccactttttcaaatccttcacctatactctcttgggtgtgggtttgccactgtttttcgttaacgcaaagtatacagattagcgttaagcctctgcaacaaaaatgccccggagttttcgtccgaggcattgcttattatcgccaaccataactaccgaagtcggtaattaaatcagaatatggtccaaagcaagtttcctcatagcccttaaaaggcttctctggcacatctttccccaaagatttttttgtttgcgtgaccgcaattctttcttcatgttgcatcgccaagcccctccttttcgacacctctattttatcaaatcctgggtcggtttgtttgttggaacctttttgtgttcagtgtccgaccgtcaggtcggacacaaaccacaaactaaataaaagcacccacaaaccatggctgtagtttgggggtgctatagatattgagttgtgaggcgttaacctagattagaattggtctgacaacaaagtgcggatctcttccaaacgtggttgacgtgggttacctggcgtcgtttggtcgttgtataccaagtcaggcaaagtctccaaagccttgtcaaagtcagcctttgatacaccgtttgctgacaaagttggaacaacttctacaccagcgaacaattggtcaatcttagccaacaatgcttcaaccaattcggcatcgttctttccttgcaaaccaaggtagcgagcgatatcagcgtaatccttttgtgccgtgtaagtctcgtaacgtgggaatggcgtacgctttacgtttccagtaaccgcgttgaacttgataacgtgcttcatggcgattgagatagccaatccgtgaggcaaaccgaaggcaccaccagtcttgtgagccaaggcgtggttaattcccaagaaggcgttggcaaatgacatacctgccaaagttgaagcgtagtgcatctttgaacgtgcttcttgaccttccttagttgggttagctggggcgtacttgtatgatgtctccaagttatcgaaaatcaacttgatagcttgcaaagcccatggacgagtgaattctgaggccataactgaaacgtatgactccaaggcgtgtgacaaagcgtccaaacctgagaaggcaaccgtgcgctttggcaccgtcataacgaactctgggtccacgatagcaacttgtggcgtcaactcgtagtcagccaatgggtacttaacgtgcgtttcgtcatcagtaataacagcgaatggcgttacttctgaaccagttcctgacgtcgttgggatagcaaccatttgcgtcaagtgttggtgatcgaacttcacgatacgcttacggatatccatgaacttttgtgccaactcgccgaacaattccttcaaggcagcatcgtcgttcaagattccttcgtgaccctcttctgcagagtactcgtacaagaagcgagcaatcttaccagcgtcaagagctgaacctccaccaatcaagacaacagtgtctggttggaattctgacatttgacgggcgatttcgatagcttgaccgatagttgggtcaggttgtactgaaccgtagattgacgtcttcacttggtcttggcgcaaagcaaattggtccaaaatcttgtctacgaagccgaacttaaccattcctgggtcggcaacgatgaaggcgcgatcaatgtttggcaattcttgcaagtacgtgattgcgtttgactcgtagtagatgtcctttggcaaacgtacccattgtgggcggttacgacgacgtgcaaccgtcttgatgttaagcaaatcgtaagttgacaagttgtgtgacaatgaattcttcccccatgatccagttccaagcgtcaatgatgggcgcattgcgtcagtgtagatatctccaacaccaccgattgagtctggttggttaaccaagatacgtgatgcctcaatcttgtcggcgtattccttaacgaatggatcgtcttgagcaccgatttggatagcagcgttgtgtccagcaccttggtagttcaacaaagcgcgtacgatttcgatagcgtcttcgcggtcagcagccttgtagactgacaacaatgggctcaacttttctgatgacaaagcttcaccgatgttcttcttgtccaattcgaacaacaaaacatccttgtcttctggcaacttcaaacctgattgctcggcaatccacttacctgacattccggcaactggtccgttaacaccgaatccttcagcatttggcttgaagacgaagttagcaaccttctcgtagtccttctttggcgtcaagtatgcaccttgttcttgcaacttgcgcataacttcatcgtaaacaggggcttcgataaccaatgagttttcagtggcacagatcataccgttgtcaaaacgctttgacaaaagcaagtcttcaacagcgcggtcaacgttagcagttgcgtcaacgaatacggcaccgttaccagctccaacacccattgatgggtttcctgacttcaaagcggcgttaaccattgatggtccaccagtagccaagattgaagcaatctttgggttttgaatcaaagtcgtcgttccatctagtgatggcttctcgatccattggatgaagttcttaggagcaccagcggcaacggctgcatcgtaaacgatcttagcagcgtgtgctgatgacttttgagcttgtgggtggaaggcgaagacaatcgtgttacgcgtcttagcagccaacattgacttgaaaatagtcgttgaagttgggttagtcgtaggaacgataccagccaaaattccaagtggggctgccaattcaaccttaccagttacgcgatcttctgagataacgccaaccgtcttgtcgttcttgatagcgttgtaaacagattctgatgcgaagcggttcttcgtatccttatcttcgacaacaccacgaccagtttcatcgtgagcttcgtgggccaacaacaatgagttctctgatccagccaaagccattgcggcaacgatcttatcaacttgttcttgtgtgtaagttgagaattccttcaacgcaacttcagacttgtcaaccaattctgaagtcatcttcttagcagcttcgaaacgtgctgccttttcttcttccgttagtaccttcttcttaggtgcatcagccatgattataacctctcaaatatctttcaaaaaattcgtttgctcatttattaacatacttagtatatcatttcacaaaatgttgtcaacaccatttgccaaaatcgattatttttaccaaacatatgcgtcataccaacctttcgcgtctcttttttctacaagtgaataatatcacataaggtcaatatagtgcaactgtttgttttattttcatgaaaataagtgatttatagctaaaaatgtatgcgttttcatatttttgtgtaagttaataaaaggattgtgaaccgcgtaactagtggattcgtgcccttataaactaataaagagaaatttaccggagtaaacttctctttatcagttattcgttatgtgcgtcgctctcacccgacgttagggacagattaccaatcgtttatgaactttgtctaacgataacccttagactttttgactaattatcgcaatatcaaacaagcaccccctgcattggtatttccaacgcagagggtgcttgttgcttataactattgtttctttggtaatttgaatgtcttggctgccttcatgatgatacctgtgatatcacctggggtaaccttttcgcctgattccagttcgtttacgatggcccagccgattgcttcagttaaaccaaccgcggtcgccattgagattgctgcaccggttgttgttccgataccagggacaaactttaacgcgttccccacgacgccacgaccgaatgatgtcgcagcgactgcccagacggcaccacgcacggcaccttccatcaccttttgatcatacgccttgaacaacgacgtaatcatcgtgacttgaattggcacaagcaacgtggcatccgtaaacggaattggtgacaaggccaccgcaccagctgcgcctgatgctgagtgaataatgttttttgctttttcatttggtgtcataattccacctccataccgttattataccgaactcccacaaattaaaaaccgaattcgacctgccaatcgggcaaagtcgaattcggttctttttatattattaccagatcatcacacgctcttctggtgcgcggtacatcttatcagatggttgcacatcgaatgtcgtgtagaagtcatcgaagttagaaactgtcacgttaacacggaacttggctggtccgtgaacgtctgaagcagccaacaattgcataatctctggacgagccttttgacgccagatagttgcccagctctcaaagaagtcctccgctgagaaatcagcatcacgctttgcggcagccaaagcagcagccacaccacccaagtcagcgacgttttcagaaaccgtcaacttaccgttaaccttggctccgtatgaatccaagccgtcgaattcatcgacaaccttttgcgtacgctccttgaaagcttcgtagtcttcttccgtccaccagtcattcaagctaccattttcatcaaatgacgcaccgttcgtgtcaaaggcgtgtgaaatttcgtgcgcgataaccgccccgattccaccgtagttagctgatgaagattggtccaagctgtagaatggcgcttgcaaaatcgccgctgggaacacaatttggttttgttgtggatcgtagtaggcgttcaccatgtgggctggcatgtgccactcctcacggtcaaccggttgattccactttgaccattggtaagccacggcttgcgcgcggaacttttcagccgtctcaaacaaggcagccccatcgtccacaatcttatccttatagcgatcaggcaacttttctgggtagccgatgtgtggcacaatcgcatccaacttcacaaccgccttatcgcgcgttgcttgttgtagccaatcagctgattgcaaccgttgcttgtagacatcaatcatcgtcgcaaccttttgctcaacgtcttgcttagctgcctcagagaacttctcaccggcataccacaaaccaagcgcttgtgtgtatgggccagcagccaagtagtaggctgccttttgcttgttcaaagcttctggcgttcctgacaaagcgcggccgtacgcaccacccaagacacgaatctcatctgacaggtagctcgtgaaggcattcgcgatacccacaatcaacgttgcttgcaacaatggccaagcttcttcagagaagaattggtctgatgcagcccagaaacgctcttctggcaccacaatcatgtctggcgtcttaccagtcattgcttgcaacacatcgtccattggcaattgcgtcaacgccgtgaagtccgcccacttgtatgggtggtacaacttagcatattcagcagattcttcttggctcaagacaaccttggcaatacgcgcgtcatacgcaatgtacttgtccaacaagtccttgattgcgccagctgagaaaccaaactttggcaacaagtcctcttgcgctgcacgccacttagccaacaattccttaccttgctcatgatcttcagcatagtaagtcgtatctggcaaaatcgtacccaaagcatccgcccacaacacatttgtacgagcatccttgaagtcaggtgcaatgccaaccgggaaggcatttggcaaaccttccttttccaactcaatgatgtggctcttaaagtcagcgaatgactcaaaggcttggtagcgcgcaatcaatggcttaaccggctctgcacccaatgcatcacgggtctcccaatctgacgtcaaacgatggaacttaatgaagttcgtcaaaatctcgtcagttggggcatccttgccgtccatccaagcatcagtcgtttccaacatcatctcttcaatttcgtcagccaaatcgctgaagccacctgtgcgtgacttatccgcaggaatcaccgcttgcgcttcccattcctcgttgattgcatcatagaaatcatcttgtactcgtgttgccatgtgcattacctcgttcttattatttctcactattctaacactgaaccatgaaataagcccgaaggatatgcggatgttatcgtgcgaaatgcatattctctaaacaacaaaaggagtaccgtcaacacgatactcccatcattaactatactaactacttaccagccaaagccatcttggcttgtttgatacggataatcttgcgaatcaagacaccgataatcgtggccacaaccaccatcaaaccggcgaaccacaagaattctgaacggatcgtaccagttggcaacgtatcacctggtacttgcttacccgtcaccaacaaacggtgtgagttcaccccaactggcgtacaactaaccaatgtcaccaagttctccttagggttcaacttgaacgcgttttgcatcttatcgggcttcatgacacggatttcaacaacttcatacgtaatcgtcttgctaccaagcgcttcgatgtagaacttgtcacctttcttcatcttatccaagtccgtgaacaactttgatgttggcaaacctgagtgcgccatgatggccgtatgcaagccttccttgttagcttgtggcaatgacgtacccggcacaataccagcacctgtacgcaacaccttttccttcacagagttgtagattggcaaacgcaaaccaccaagttcaggaatcgacaagacacccagcggcttaccggcaatcttcgtcaaagaagaattcttacccgtttccacatccttcttttggttcagctcaatcatcgccttcaccacgtcaggatccgtgtcaccgtttgtgctctgtgccttcttcttaatttcttcgttacgcttatctgcttcagcctgcagcttcgccttttcattggcattcatttgcgcagccgttgagcgataattgctaaccacaccagattggtgagttgcttcatacgcttgcgtcacgattggatatgagaaaatactcaagcccacaataaacaatacccaggttgacaaactggccccggccataaacttctttttcttctttgccattcttttctcccccgagttaatagctaaatatgtatctcgccgatcacccggcgagtaaactaatcaagattagtcattgttttgggcacggcgcttcttaatcaaagcaatcaaacctgccaagccaagcaacgtcaacaaaccaccaagggccgttgccgtgtatggcaagataccaccagcgtgcgttggcgtatcgttaatttgtggcttttcatcgcggtagttggccaccgtgatgtcgtctgacgtcgcagcgccgttaatcttacctgattgcgtgtttgacaacgtgaagtaatgtggctccgtcatcaacttgtagcctgatggggcttcacgctcaatcaattggtaatcaccgccagccaatccacagtattgcaagtatccgtcaggacctgagtagtgggtcgtggcattgtcttcacgaatcgtccacaagatgtctcccatcggatcagatgcgtttgagtgcattgatgccattggctcacccgtcgtcatatcttcgtgcatgaagtatacccaacgcgtcttgccggccttcacatcatcacggagttgttggacatcttgctcagatgccgtacgcttcatgttagggaaacgctctgctgaatacatttcagcaatgatttcatcaatattcgttgacgtcaccttaagtcccaaatcgaatccggcaccagccaaaccgttcgtgatgttaccgttactgtcagtcttcacttctccatccgtcttgatgatttcccatccagccgtgaatgtgtgtgtcttatcgtcgtctgatccaccgtcatacttggtgttgtaatccaagtcaatcttgttgaccaagtgatccgcttgtaatgccgtgttaccagctgagttaatcttccaactcaagttccatgaaccgtcgtcagcaccttcagccaacaacttttcaatcaacgcacccattgcttggcgaccagaagccgtcatatccaacacgatttcaccgttttcaacgggctttgtccagtcaacaacacgggctgggttagctgaatcaccttgtccaacgaatgtgtacgtactctcgtgaccgaacaagttgaatgatgatgcatcaaagccttcagccaaactcgtcacttgtggtgcagttgcggcatcataagcaatcgtcttgccattcaacgttgaaccgttttgatcagtcgtaaagccaagtcccttaccagtcacaccttcgtcaatcaatgacttgtcagttgcgtggttcactgggtacaagccattgaccacttgtgacaatggcactgactttgtttcgccattttgcgtgtacgtcaacgccaaatccattaacatccagttcacttgatatggcatttcatcagtcaacgtgtagttcgtgtaatcagcaatgttcttgttcaactcagacgtgatgtcccatgtgaacttttgtccacgggcgataccttccttgtcatctccagtgcccttttcatcggcaccgaacgtttggttatcaaccgtaatcgccttgtcgacttgcaactcatcgtagttgaccaacttcgcagcgttttcgctatcttgctcagccgttacaaccgtgacttgtgggtccgtcaagtagcccttaggcgccatcaattcggcgatgacgtattgttgtccctttgaaatcgcgataccgtcgtttgcatcaaagacaacttgtccatctttatcagttgattcgattgagaattgatctgacgtcaatcccaacgcagaagcgaccaatgcgtccgccttcgctggcgtcttttcaatatccttaatcaattgtggcaagacttcgttcaacttgtcttgtactgaagctggcgcaagcaaaatttgtgcaccgcccaaagccttctcagtctccgcgtcagtcttcttaatcgtcaatgaagccgtcttgtattgcttcgtgtaaacgtgcaaaggtgaatcagtgtcataccagtagtcagtgtctgatccgttaaccttacccattggcaagtccaagaagattggcaacgcttcatctgtaccagtagcatcagaatcttgtgtaattacccattgtccgtttggcaacgtcaacttcgtttcaccgtcaccatcagttggaccactagtttgcgtcttcaacccagcatccttcacagcagcaacaaacttatcacggtccacgacttcaattgtcttgccagaaatatcttgtgttttggcatcattagtcgttgcagcagtcttcggtgcttcaataaccttcaatagctttgaccagttgatgcccttaatcttttcagttgcaatcttagggtcactgccagagttcgtgtatgttacaaccccatctggcaactcatatgccgtaaacgttgcgccagttgtcgtttcccaagttgtgtcaggatcggcatcttgcaatgtcttcaaatccttttcttcacctgatccccacaatgttggtgcatcagcagggtcactatcactaacgtccgtaatagcgtgaatcataacgcttgtgctttttggtgtgtcattgatgcctgacgttgccaacgcatccccagtcgttagcaaaatcggtgcaatcaacgtccccattaatagtaatgaacgatgctttttcatccgcgtatctcctcaaaaatcatatccttatttttaaccccatacttgaccacgtatgagtttttcttcacagtaaaattctcacaaaaaaaaacggcgtttccgccgtttttgtgtttcacttttctatttaatttgtgcctgaattttgttattcgtgggcattttgtgaagagtgaattttcaacacagtctatcgaaaaacggtaatcaaatcatttctgattcgattaccgttttcgtgttctttcacatatcgtaagaaagatatcatcgcaaaggcgggatcaatctcgtctttctaatatgtcttgtcacgttttctggaatgtataacgttattctagcttacaaattaagcttcgttcttcatatccttcttacgcttcaacaatgcaagtcccattgccaacaatccagcaatcactgcgaacaacgtaccaagtccaccgaccaatgggaagattgacttctcgtagttgataatttggatgtcatcagtgtcttttggattattaggatcagcaggaatatctgctttaccattgattacaccagaagctggcgttgaaccatctgaaagttttgttccaggcattccaagctcgatacccttggcgtgatcgaacttcgtcccgttcaaagtaatagtgtctgtaatcaatgtgtatcctgcaggagcttggcgctcaatcaaggcatattgcccagctgctagtccacagtattgcaagtatccatcagttcctgtgatgtgtgttgttgcccatgcggcaacaggcgtccagatgacgtcacccatcactacgttttcagaacccatgttcatgtctggcatatatgcacctgtagtggcatccttgtgcataaagtaaagaacaccttgaccaccagtttcgtaatcagctgcgcgcatcattgagatcaacttatcgtgcaaattgtttgagttattagcaactgtcaaagtaatgtcgtcatctgatgttacggctgaattataggcaattgccatgatttgagacttcttttgctcgggagtcaggtcgtcattcgtagcaatcgcataagtatctaatgatgagtactctgagtccgtaaattgatcactaattgccgcttgatagaacatgtccaaccacgggtttgtatcagggttcgtgtcagtagcgttcttacgatcgtagactaccgcagtgccgtcagcattcttaccttgatagaagttgttcaatagcgctgcacgcttatccttgtcggctgcgttatcacctgcaggaattgcaacagccaaatcgaatccagcaccagccaatggcgtttcaccatccgccgttgtctttacaatttcccaaccagcatcaaatgtacttgctgtgtcagtacgtgtctccacgtcccatgggttagacaacttaagttccacgtcgttttcaatctttgaagcttgtgcagccgaatttgcacgagcgcccaacgtaatgttcaaacctccttcaccatcaactggcgttttgtttgtgtctgcgatttgagcaaacaaaatttgtgctgccagcgacaattcaatcttcaattgaccatcagtcggagcagcatcgccctttcccttaatagtgcgaccaccatctacatattcgtagtatgatgagtatcctgaaatgtgtacattgctgttcaaccaagctacccatgacgcagcatcagtaactcccgctggcaaagccacaccagtagctgtcaaattggcataatcggcagttgtagctttgacagtaactccttgatcaagagtgtgagctgtatcagttactactgcaccaccattgtcttgatcccaatacgttacattctcagtagattggttgtcataggcaacgtggtgtcccgttgctccgccttggcccgtccaaccattgtgcataacagtgaacatttcacccaacccagcaatatctacagcgaagtctgtccaattagtttgatatggcacagaatcagtaaatacgtatgttgtgtctgctgtgattagagttggatcctttggcaagtcagcattaatcaaccagtcgaagtcttgaccacgatcgacaccttgagtcgtgtcgttctgtgttgccgttgatccaacttgtaccttcttagtaacacccggctcaaagttattcaacttaaatgttccacccttgtagtgaacaaaaccatcgttggcatcttcatcatctgtagtgtcatccgctgtagacaatgtgaatgaactcatatctgaattaatcaaataccccgcaggttcaaccaattccagtacttgatatgtttcaccagggttcaaactcgtaaacgtcgttccagttccagtcccagttgcacctgtcatttgaacgccaatgatttgatcagcagtcaacccaactgtttcgccctccaacaatgcaataatatccgctgctgatgttttagttggatccaggtctttcgttgccgtaagtgccttcttacgttgatcatcagaaatcccttggaacaagcctacccatgctccgtctacacttgcaccagttttgtcatccttcttgtcaacgatgatatcaccgctatccgtgtagttctttggatataggtgcaaagcgtcagtagatcccgtaccgtaccacttgtcagtagctgatgcatccggcttttgcgttggcaagttcaagaacattggaacagacttttccttaacgtcgtcgtccttacttgtttcgaaaatcaaccattgaccattatccaaaccattaaagcttgcaattccagttccggccaccgtattttcttcaattgccgtatttttagtaaacgcctcaacgtccgtaatgaattcagcttcagtcataccagatggtagagtcaatgacacagtgtagtcattgaccgatggcttcgtgttgccttgatcatccttgttgtttgtgtacgtatacccagcagctggttccgcctttagcagatcagcccatgtatagtccttgccaccatacgacaacaccgtttttgtattttcaaaaactggtgcacccgtatcactatccatttccgtaattacagacttaactgtcgtgttcaattgaattgccgtaaattcaaacttatcagacgtagcagggttccaaccttgcaataagctctggtccttctcactaccacttccccaaagaacattttgactgtccgtaccgtctgtggtcgtctccatcttgtgaacttggacattcgtgctgcttggacgatcagcttgtgcaaacgcatcccccaatggtgacgccccaaaagcaataggtgcaacgattgttgaaatcaacaaagcattcttccatttagccatatagcatatctccttaaaaatacaatctacccactcgtggctcgatttgtttgttttttctttactctataattctgccgaaaaaaaatacctaaactgctatatgcacgtttaggtattttacatcttatgtgttttattacgggtttattacagttgtttttgaataaactctgaaattgtggatttttttagcgagttagttttcgcgcatatctgtcttacgcttgatgtatgaggcgatcattgcaattgctccgatgaacaacaggctcaacgcaccaacaccaccaacaactggcaaaactgacttcttgtagttcttgatttcagcccagttttgaccttcaccttggttttcaccagtaatttggttatctgatcccatgtcttggttatcacccgctgacgttacaagtgggtattcatcaaggtcagccccccttaccacttacatagtatgaacctgggccaccgattgtgaacttcaaatcatccatttgcttgaaaccctttggcgtaatggcttcgtgcaaaacgtattgtccgtcggccacaccacagtattggaagtaaccatctggcgtagcttcatcttgcatacctgacatgtgagtcgttgacaactcttgatcgactacccagtaaatgtctcccatttccatgtttgaagccacggcatcgattactggctgcttcgccgttgtgtcatccaagtggataaaccagaccattgtttgtttgtcatttttaacagcatcacgcaatatattttcttggtccttcaagtgagccctaatctccgctagcttagccgtattatcaccggtgtatcccaacttgttagccatagccaacaacgtagtttccgttacttcgtgaccattgttattagcactaatcaattgagaaataacattttccacattttccgcagttaccacacgccccaagtcaaatccggcattaccaatggcgttaccctttgaatcttctttacggaattcccaaccaaccgcgtgcgtttgtgattgatcacgcaacgtacctgttagatacccgttgttgtaattaaacgctacacggttgttaatcatatccgtttgagcatctgtagaagctggatctttatcagagttagtaccaccaacattggcttgtgcagccgaattcgtttgcgcattcatcttgaacaccaaacttgcgttattttgctttgtagacgcattcttaaagcgttgccagctaccatacttttgtaggaacgttggcttaaagtcaatgttcatttgtccgttcaccggcgcttctgcacccgttgtctgaacagctcggttttctgggtcaaagtgatattcacctgactgtccatgcatccaaattaactcatcagaaatgtaggccgtttgagcttcaagtgatgccttatatccagcatcggttttgtcgttaatccattttccagtgtaaccaaacaacgttgccatttcttgtgagtagaacttgaatgatacacccttcttttccaaatcaggattatctgaatcataaggctgcgacttttgtgataatccgtcagttgttgagtgatctgcttcgttaccatccgggtcaacggcttgcaaaattggcactagaccatcgccttcatccttaccagtagccttttcaatcacgccaccctttccaacacgggcataaagcgtccagctgttaatttcaacttggtatggcacagtatccgtgataccaaatgtcttgtagctagcaatgtcaccgtttgtttccaagtcgattgtatagttgaatggcttaccacgtgaaacaccgaattcagtgtcgttatcttggaagttataatcgtaatcggcattcttgttgtcatagattgggttgccgttttcttcaataccattaacttgcaggtccgttgctccggctgcctttaggacgttaatatccttatccaaaccaggaacatcatagttcttcaactcgtactttccgccacggtggtgaacggtggtgtcatttgggccgccaattgtcgtgtccggagtttcatcacttgctgcattcaaagttgccttttgtaagtaaccatttggtaggtaaccttctggagcagcaacttcaagtacatagtaggtttgacctggcaccaaatcgttaaagacaacccattgtcggcatcttcaatgacatcgtactgaagtgaaccatcaacggcatattccttaagtgtattttcaatatcctccggcttacctgatagcaacccaccttccaacaatccggtaagcgtcttttcattgtcagcggtcaactgcataattgcaatagttgcgccttcaaccgccttatttgtttcagcatccgtctttacaacacgcaagtttccagtatccgtgtaattcttaggatacaagtgcaatggtgttttttctccaaaccaatcttgcttaccatccttcgtgtcagcgttcaacataggcaaagataataccatcggcgtggcaaaggtctcgataacatcactttctgtacccttcttgatatcctccaagatgatccagttaccattcttcaaattttgtgaagtttgaccgttatcattagtttgcgcaaacacttccttgtcgtcatccgttagtccttcatccaaggccttacgcaagtcaactgcattaaatgccgttgtccccgtaaattcaattgcataatcactctttgtatctgaatcaaccgcgatacccttatctttatcaagagcctctgtgcctttaacgacattcagaatcttcttccaagttacgccatctggtgctcccggcacttgtgcattagaaatttcaggagcgccatccttaccgatggaaatcactttacccatgttaaaagcagtaaatgaaacgcctggttcccaactccaaccagagccaggcatgttagtgtcttcgtttccattaccccagtacaagttttcagcattattacctgaatcctcagcaccctttgtatcgcgcttatgcaaaataaccgttgtaccgtcactatcatttgttggtcggttcgcttgcgcaaaggcgtcacccacaccaaacgcaatcggcgccacgatcgtactaattaaagcaatatttttccacttcgccatatcgctatctccttaagcatttatatcatttaataatttcgatattctcttacgtctatcagtttcgcaaaaaaaaacacccaaactgcaatgtgcacgtttgagtatttttgagtttgtatgtttaattcttgtcgcttaactgttgtttttgacgtttctgtcgcaactgttaaataattgtgccttttattgccaactttgaattttttcgttcaaagccttttcgagattagcttggcgatcagccgtcaccttgttgacgatgtcgctttgcaacttttgttgggcatccttatccttcataaagttctcgtcatccttggcacggtctgcgaattgctttttaacttggttcgcaacttcatcggtaatgccgttgttgctatccttcaccatcttttgcaattccttgacttgcgctgacgttagcacgtcccaatcctttggcaccgttagcacgtattgtgtcttaccagtctttaactttgtttcaccgaacaacatgaagcggctaaacaatgacttggcttgatacgtcgtcacaatcgtttccaattgggccgtctcaccagtcttcaccgtcgtctccgcattttgcgtcaacgtttggtatgacttattaccaaccttgtaggtataacggttttcaccattgctacccttttcagtcgtaataaacttgaagtccaacaaggttgctgctggcttaatcttttgtgtcttatctaatggcaccttcgtcaacaagaagtttgaatggtgggccgtatacaaccccgctgccatggcgattgccaaaacagttccactaatcagtggcatccatcgcaccgtgtgttgttgcaccgaacgcaaaatgccaacgactacaataacgattcctaataccaacaacaaaatcatgctatcttcctccggctcttaatataactagtatatcaaagtcggcctactttttgtcctttgtgcgcaaggcatggacataaattatcaaagcccatacgcaaagcaaggtaatcatgaatggaaacgccgtcttcttcaccatcgtcatatcttccccattgatgatgtcacgcgcacgaatacgcgtgtccaaactcggcgtgtctaaaactttttcatccaaaattaaatccggtgtctcatacaacgttgattgactcgactctgatcgattgtcagagtgagcgaccgttgatacgcaactcatgctcaccaaggcaagcataatcagcaatacacgtttcaacatttccatctccctttaatatctatctttccaatggtctatactacgtgaccttcttgttgaaaataagatttattgatactgaattcaggagtaaatgtgaattaaattatttaattttggatgggacgaaaattagacagataatactgtagtggcgcgaactgtggcgcataatccaccggcgacacatcggcacgcagtacgtccacaatcgccacatcaagtgggccatcatttggtgaccaaagggtaatccatggcactgccgtacaccacgcttcaaacatcgcccccatcaatcctgactcttcggcaatggcaaccgttggtgtttgcgtaatcaagccgaatagcaggccatgaatttcgtcggttaccaatacttcatagcctgacatggcgcgccagcattcacgtagcgttgtatcacgcttgtggccacttagatgcaagtgcttagtgttcaggtaatcttcttccgtcacccggccaaagaggtcgctaattagctctctgacctgctcctgcgttgcccggcggaaatcattaccggatgcatgcaacatcaacatggcaccatttctaggcttacgactagccgccaagcgtccactcaagtgcaaaatcatatctggaattaacattgctgggcaaagcagcaattgcgttaagtcttgtagcgctttttcatcacgcgccaacatgactagtcgttcagctgtgttatacacctgctttgagatttcacgttcgcgtgtactgttgaaaaacattgattgtggcaattgaatcatcggttgatccttcaaccaagccactactgaacggcgcaaattctcctcaactagttcacggtcaccaatgatgccaccaccatgtagcaagaccaggttatccggttgaataatgcggtgaatcagtggcaacgcttcaaccgtcgcttcagctggcaccttcacaatttgatgctctggtaagtttgtccgcaaaaacaattctgtggcatacgcaaccgcgtgatcgcctagatcaccgtgttctggcataccaatgtagaaaaccgtaggtaggttcatatcaagatttaaaagttgttgtttcaactgtgggcgaattgtccatcgccacgtgatacgcttatgtatccattctccaaatttattgaccataatatcttccccgatttaaagctatcttctactatgcctgataaatgtgggagttctatgaaaatttccaggaacgacaaaaagaccattactaaatctcgaaagaaatagtaatggtctttaagttaccctttaaccggccgaagccagcctcaggtcaatttttatttcgcttagaaattaatcgtacggcagtagattacttcttcaaagcagtccacttccagtcagtgaactcttcgatgtcgcgaccttcgttacgagtaacttcgaagtgctttgccaagatgtcatccatcttcttgtcgaatgcagcagcctcatcagctgaaacaactccgttagcagccaagacagcaacagcgtccttagcttggttgaagcggtccaactttgagtatacacgcatgtcgtaagtcgtagtgatgtcaccatcttcacggtatccgtgtatgtgcaatcccaagtgttgacgctcgtagaagattgactcgatcaagtcttcgtatccgtggaatccgaagacaacaggcgttcctgactcaccgaacaaagcgttgaacttgtcatctgacaaagcgcgctcgtggttcatctcaccgttcttgttttgcaaacggtgcaactcaacaacgttgacataacgcatctttacagatgggaatgcatcgttaaccaagttcaaagcagccaaagtttcgatcgttggctcaacaccagcagatgcgaagacgatgtcagcttgctcaccttcagcaacagttgaagcccagtcaatagccttcaaaccttcagttgccaattcttgagcttcttcaactgagaaccattgttgacgtggttgctttgaagcaacgatgtggttaaccttgtgacgctcagtaaatgcgcgaccaaagacagccaacaaagtgttaccatcagctggcaagtattgacgaacgaagtctgacttcttttcagccaagtgcgtcaagatacctggatcttggtgagtgtaaccgttgtggtcttgttggaatacagttgaagttgagatcaagttcaatgatgggtaatcgttgcgccatgattgctctgaggcgtgacgcaaccacttgaagtgttgagtaatcattgagtcaactacacgtaggaatgattcgtatgatgcaaatacaccaacacgaccagtcaacgtgtaagcttccaaccaaccttcagcttggtgctctgacaattgagcgtccaagatacgtccctcgtgggcttcgtattggtcgtttggctccttaacttcttccatccattgacggttcgttacttcgaacatgtcccatagacggtttgacatcgtctcgtcaggtccgaagatacggaatgacgttgggttcatctttgagatttcagcgaagaatcctgacaacacgttcatgtccatgttgcgctttgagtcagccaattcagttccacggtttgactcgttgatgtcgttagcgaattgcttccaatctggcaaagccaaatcttgagcttcttcaccgcgacgacgtccaccgttggcgattgggtttgaagccatacgcttgtcacccttaggtgccatttcagccaattctgacttcaatgaaccatcttcgttgaacaattcagctggcttgtatgagttcatccactcttcgaattgtggcaacgtttccatcttctttgatgacaaaggaagtggaacttggtgggcacggaatgaatcttcgattggcattcctgattggtcgtgagtaggaccaccccaaccctttggcaaacgagcgatgattacaggccaagctgcaatttcaccgtcttcgtaacgaccgttctcacgggcgtccttttggattgcttggatgtcttcgatggccttgtccaagacattagctgccttttcgtggtatgccatgtagtcgtggatgtcatcgttttcgatgaaacgtggtgaccatcccaaaccttcgaagaacttagtgatctcttcatcgctcatacgtgagaagatcgttgggtttgaaatcttaaatccgttcaagtccaagattggcaaaactgcaccgtcgttcttagggttcaagaacttgattgagtgccaagcagtcattgaaggaccagtttcaacttcaccgtcaccgataacagtaaatgcgatttggtttgggttatccaaaacggcaccagttgcgtgtgacaatgagtatccaagttctccaccttcgtgcaatgaacctggcgtttgtgcagtcatgtgtgatccgattccaccagggaatgagaaacgcttgaacaaacgtgacataccctcaacatcttgagtgatttcagggtagttttcagtgtatgaaccgtccaagtatgagttcgtaaccataacttgtccaccgtgaccaggtccaccgatgtagaacatgtctagatcgtacttgttgatcaaacggtttgcgtgtgcgtaaaggaaagtttgtcctgagatagtaccccagtgaccgataggcttaaccttaacgtcttccaccgtaattggtgtgttcgtaactgagaacaatgggttgctcttcaaaaagatcatacctgctgaaaggtagttggtagcacgccaccaagcatcaaccttagcaaggtattcctttgaatcaaaatctactgccattttgattaaatctccttataattttgagaaaaggttcaatcgcagaagttatcttctggattacaaatactataataacagatttcaaaaattggtacaataaaaagcacaaaattggtgcggtccaattttgtgctttgcttatttttcacctgtaaagcctgatataatcgcttttctagccaaatgtgaacaatttgtgaattttggattattcgccgtccaaactgacgaaactgttatatcgcatgtacttgtagtgtacgcgcatcgttccaacttcaaatggcgtgccatcatccaggaagtaaataccggccatcacgccgactggttcaacttcactcaactgcaagtggctgcgatcatcttcgtcagacggttcaaccgtcaccgtcataaatgacttcgtaaccgccttcttggtcgttgcttcagcgtagtggaacattgagtgacccaaatcttcgctggtcaactctggtagcagcttaactggcaccaaggcattctcaatcatgaacgcttggtcttgcaacttacgcaaacgcttaatgcgataaacttgctcccctggttccaaaaagagtgctaaccgcgtttcttcatttgcctcttccgtctcaaatgacaacaattggatagccggtgcttcgccgttaaagcggaacgaatcagaaacacccaagttattaccaatcgcatggaacattgattggtttttgagatatagcgggttcacgaaggttcctgagccacgcttcttaaagataattccttgctgggccaagacgttcaacgcgcgcttgattgagctgcgtgacacatcataagacaaggccaatgatcgttcatctggcaatttcaagtttgggaattcgcgcttgtagatgcgatccttcaaatccccaagcactttcatgtacagtacttcagttggcatttgtctatgccctcccgtttttaatccggttttatcgtaacacaaaagtggtccaaccaaaagttttggttggaccacttttttaaatagtatctgaatcatcgctatcaagccatgacgtaaaatcttcgtcactctcgaacttcggctcaaatcctgcacttgtagcaaatgccacaatttcattatttacagtaaaccagtcgttattttgaattgcggtctttgcattttccgtaatttcaaaaaacttctttttcgcttctgccaacttttcaaccgtcgcatcatccatggcttcttgcgcagctttaatatctgcaatacgagcatcaaatatctctttgattcgctctgtgcgctgctcatatttgacaccaaaaatatcaagtcgatccatggcatacatgaacaaagccgcagcgacaccagccagaatggtagacaaaacacccgaaatgggttcaattacattggcaggcacacccacaagttttaaaagctctgtcactagtgtgtcaaacaccttccctgaaagtgcaataacagtcgacccaaccaatttaactatggcatcccccttttgggcaggtgacatgtttttcgaatctttcccaaacaaaattttaaatgcttggattgccgcaccgatagcttgcttcactatcttataaatctttgcaaaaatccccacgaacaacgataaaataccgtctataaaactcaacaggaaagttttaagcaaatcaaatataagcgatcctatgtttttaagttgcctcaaaacataacgggtcagtcgcttaaaacgatactttatcgccgcgccgttcttatacccattaacatcaatgccattcttcacaatatcctttatttcatacgtcaatggatttaataataaacgaattgcttcaacaaggcccttgttcttggcttgctcaccaccatcactagcggcgtttttcccaatggttttccgcatatcacctgattcttttccaagaaggttttcgcgcaacttcgcgtttacatttttttctcgagctttttgcgactccttctgtttctcacgcatcgcagtgcgttggctatcggatattttgtcatcttttttgtgcttttgcagaaattcttcatttgaatctgcaaacttccctccgcttccacggttggtttgctcagaagtcattgcaaaattactgtcatcattgatgatagattttatatcttgctgtgacaggccataattactctccaattctgtagtaattttcttaatgggctcaatgtgatcagtttcagcatgctttttggaatcagctgagtaatttgacggtttatcccctttatacacacgtttattaggatcgtactcatcggctgctacattattggtgccgaaataactatctttatagttatccatagctgttttatcctcaaattttttacgaaactctgcggcattgcctacggtatccgctcttgcttttcgtacagctgtatctttgtgtaacttcgcagattcatgtgatgccttttgcgcttgaatcacttgttgttctttataacgatcagaatatttaggtcttgatttttgataatcaacctcatcttctggctcatactgaaaatcccacgcttggcccaacaaatcagaggctgttatccctttatctcttaccggctttaaaatatccatctgtaagaaaccatcaaaaatactaaaaaaagtaggctttacaattgagtccagcacattgccgcctttttcaaagtcagcataaacctgctcaaccaccttgtgagcatcttcttcgtcgtatagctcagcatcgatcagagcttgaggtagatcaaaaatcgacgcgttattgatattgttttttatttggtcaattgatgtcatacttcctcctttatgccgccttagcaaccttatccatttgcttctcgaaggtcttcatttgcgatacgtcttgttgcttaggcgcaacgaattccttatcgattaactctcgaatcaacttggttgcttccatcgttgcacgaatttgcatttgttcttgcttcgtaagcaacttcgaacgcttcaatcctgttgtcttattcaagagcgccacagttgcatatcggaaactcttagcctcaatttcattaagtaccagaccatacactgactcaatctgattaagtacgtctcgaatcgcttcaaaagctaacgccaaatcctctgcgcggtgcagttcggccttcaccttttcttgcgtttcctcaaacaccttggcttcgtccttgacgtgataaagcgtttccttagctcgctttcgaccgtaaattcccaacgtaaaaatattcttcatggttctagaaaatgacggcttatcaaaatcaattgtctttaatgcatcaaatgactgaacagattcaaccttcttcagactaatatccaattcctcaatcaaagcgatatcatcgttaactaataacggtttgattcgaaccatcgcttttgcaaaacgatgcaaattctctttaagatttcgttgtttccagtcattgatatcattaactgcgctctgaatacgatcgctcaaatcttgataggaggattctgatttttgtttgaacgaatcagattccttcttcaatttctcgtacatcttcgacgcttcgtccattgttgccttaccactaatttttgcagcggtgcgggcaaccattcggcctgcggctttaataccttccttaattttttctcccgccttcttaacacctcggcgaatagcggcaaacattcccataatatattccctttacctttcgatcatgtcataaccttcatcaagcaaatcattgaagtccgtcatccaattcagcattcgcttcatctcaaggtcgcgaaatcccaaatccgtccccacagtcatcaaccagtcttcctcagcatcatcaacaacttcatccgcatcagctaccccagctagctcaataaaaatcgcacgcttgactttcttggttgagctttgaaaatgcataatcaattcttcgtaaggaacatccttaaactcatatttttgaaactcagtttcaactcgcaaggcgttcataaagcgctcttcctgttcattcattggggacgaatgctcgaagcttaatttcaccaactcaataaaatccttttgctctcgcttgttcaaaaaatttaaaaacatattacttcacctctttgccgtttgaattatatttttgtgttgttgtgttgtcgccaacagttactttgcgttgcttcaagttaccgtttggatagaattcttcgacagaatataaattacccttgtcatcgaagttacgtacattgtgcatttgtccatttgaatcgggataataatccgctagcacacgacgaataccatttttatccaatgtcgtagattgcatcagttcaccttgaggaccataaactgcatacacatccaggtcgttatccttcacgcgttttgcctgtccaccagaaaccttccgcaaccccaattgttccaatttatcaacaggtacattacccgttgcatgaacagattcttctgtcttattcgtatcggtttgtgcaacacgcatcagtttttgtgtaatcacttgaatatccgcggtggcatctaccaatcgttgatcaatcacatctattcgcttctgtaacttttcattagtctgctttgataacatctgcatttgctcgatatcttctagcttatcggcatttccatatgcaaaatcattgaagccatttgccataatttcaatcgaatcattcaagcgcgtttcaagacggtgcaagtttcgaacgccacggtaaacatccgtttgaatcatctcactaaattccgccaaatctgatagatcttcaatttcctcagtatgattatttttaacctctgccaagatttccttattcgactcaagcatcgtcttatcgctcatctcaatgagttgctgaatgtcattaacttgtttatcgatagcaagttctagaccagaaatcgcaagctgggctgctttaatttcatcggttgcagatcctgaaccttgttcaactgcagacgtcagttgttcactttgctggtcaatcttagtatttagggcttgttcaatattttgactaccagctaccatcttgtccgacagttcattcaatgcatcaagctgcaaaatttgagcattttctatcgaatccttcacagcgtccgcactatctgacacaccatctaatacatttgtcttcaaagcacttaccgcctgctcaacctttcgataatcagacgtcatcttatttgacaatccatcaattgactctagttgcgcatttcgtgcattttccaaagacttcttcagggtatccgtattgtccgatacaccttctaacacatttgtctttaagtcacttaataacatcgcattttcacgattgttatctgcaacgttttccctaaatgattcgattgacttattggcttcttgagttttttcaccaactgaactaacttcagcaagcacatcgtcaaacctagtctttgccaactcattccaggctgcgaacgttttttcgtttgtcagtacttgatcatttacattcttaacatcaccagtaatcaatcccaagtgagacataacactttcatggttctgattagttgtcgcaccaagtgcatcagccacgccttgcaaatccgcattgaattggtcggcttgtccctccaaattgacttgcatttgttgcttaaccgaatcgatgctttgacgtgtctcgttgaactcactcttttgcgtctcatcatgtgctttcatcacagcctgcatgccgttctcaaaaccactcaccgattcactcaaactatcaatgcggttcaattgagccgtattattctcactcgccttagtttgtccctccaaaatcagtgctttgattccatcatcgttagaaatcaagctatcattttgattggtcatttgttcagcaagactcgcattggccttccaaagagcgttaccaaggttttcattaacatcatgtacgtgatttaaaatatcctctttttgctcagacaaagcgttattaatcttatcctgactatcacgcaacttgttgagtacattttgaacctttgcatctacgttcttttgaatatcgctcataccacgctcaaactcatcagcacgttcagcttgcttgtccatttgctctctaaatcgtttttcagccttctcagcatttccatcaatttgattgcttaattgattagtaacagcttctagcttggtgaactctttgtgattttccgaattcaaggtctcaatcatttttaccgactgatttgaacgttcatcgacatacttccttaagttcgtaatctcagaattaagttctttagttgtcaccttgttttgttctgtcagtgtcgaaaaattcgtctgaacctcctgagttacattcttatcaacctgcgatattttctcatcaacttcgctggatagattaacgattttttcagccgttgcttgagtatcagcatcttgtttttcttgaatactgtcttgcgtcgccattaactcgctaaacttagcatcccagtttgctttgaattctgtaacaacaacgtatgtcacagccatcagcaaaataacacctagtgcagatgaagcagccgttataatcagttgttgcccatagtcaaaagctgtatttaaaattgcgagcgcaatcaacactactgaaaccacaaataatggttttttataatccgaaatagccttcatacatcagtcccccaaattgatatagttggtttatgctttagattataaaaaagaactcactgcaattggtgtttgaacccttgaagactaagacaattcaaaacccaacaagaaaaatatctataaattccttatttattcaaaaaagagcggaaacatatcgtttccgctcttttctatgcgttatttcgttgcttaaacaattgcgttaatccgagtgataagacgaccaatccggtcgcaatccaaaaggctgcgtgaataccagccaaatcggcacgcgcttgggccatttttgctggtgcgcctaatgaaaccagactgtagacggtaatcaaggccgccgttccaaatgaggcagcaacctgacgaatcgtcgtgtacatcgctgatccatcaggcaccatctcaagtggcaacgagttaaaggcctcggtttgaattggcatcgtgaccataaccaaaccaagttgacggatgaattggccgaccgctggcaaccagattggtgaatccagttgcaacgtcgccaagacaatcgttccgataaccacaaacaccaatccgattggggctaggcgctttacaccgaactggtcataccatttacctgatgttggcgataggaacgccgtaatcaaggcaccaggtagcaagaccaacccggaaataaaggctgattgaccacgaacggtttgcatgtaaagtggcagcatcaaggcaccaccatacaaggcagccatcaagacaacgttaatcaacgttgccatcgtgaagttgtgatacttgaagacatcaaagttcaacaacggcatctttgagtgggtttgttgataaacgaacaacgccgttacgacaataccgattagcaaaaatgcccaaacgtcaggacttagccagttacccgtaccggcgtttgagaacccgtatagcaagcttcccaatccgatacttgaaaggaccatccccaagaagttgaacttcaagaacttttgttgaccgatgttcttcaagaaaataaaggccaaaatcaaatcaataatgatcagtggtgcaattcctaagaacaaccagcgccatgagtggttagacaccacgaatccagatagcgttggtccgatggttggcgcaaagttcaatgccaacccgataattcccatcgcttgaccgcgtcggtcagccgcgaacaggttcatcaccaccacgttcatcaacggtccgaagacacccgctccggccgcttgaatcatacgtcccataatcaaaatggggtatgatggcgcgaacccagcgaccaaggttcccaccgcaaatacaaataccgcgcttaagtacaacgttcgcgtcttaaggcgttgaattaagaaggctgttagtggcaccatcacaccattcaccaacatgtacccgttcgtcatccactgaccaagggcggttgagatgtgaaagtctgccatgacttgtggcaaggccgtgttcatcaacgtttgattcaagaatcccaaaaagactcccgcaatcaagatgatcaagacacctcgctctttcttgctaattccgtccatatagcctccttatattttttagtttagataatcagttcctgcccactccgcttcaaactgcgccacgaattcatgcataatcgcatcgcgcttcgcaccaattcgctttccttcgtcagtattgaggtagtccttgagcaaaaatagcttttcatagaaatggttaatcatcgtttcgcccgtcgcatcacgataatcggccttggtcttcaaatcgcgtggtggcatcgttgggtcatacaaaatgtggtgcttttggacaccatattgaatgacacgggccacggcaatggccccaattgcttcgagacgatcagcatcttgcacgatttgaccggccaatgtgagtggctctgggttgccgaaacgttgcttgctccatgacatgttatcgataatttggaaaatttcagcctgtttagcctcatcaataccattatccgtcaacatgtccacaactgcttgtttggcgcttgtgacatttttaaataacttatcgtcatacgtgtcatgcaacgtcgccgcagccaccgcgataaactcgtccgcggttggttcagtcgtcaaaatgtgcttagtcagcgccacaacacgctcaatgtgcgtcgtatcatgccctgattcatccccaccaagcactttttgcataaaagcagtaatagcaaccaactgttgttcttctgtttttgtcatcattattccccaaattttattagcgtcgaccgataatcgcggtcaacatgtacatgataaacgtcgctgccaacacgccaccaaagaagtaggcgattggacgaccaacggtttcccaaataataaacgcatcgttaatccataggccaacacccaaggcaacgatggtcaaaaagataaagtagtacagcgcaccactcttggtattctgccaatcagcatcactcaaattcaatgccaaactcaaattcaaaatggcataaatccacagagcgacttgccaccaggcggtattcagccacacgctactgccgtcgtgaaacctaattagcagttgtggccacaatagctttgttaacccccaactggttaaggcaatgccgaaaatcggtgccataccaatgaaaaagttaccgagttgttggtacttattctttggattccaggcatgtgacacatagcccatgcgattctcattgccttccttaaacggattttggagcaacttgattttgtcgacgtggtggccaaagatgactgacatcaccgcatgcgaaatttcatgaatcatcacgccaaaccagccaaagataagcggtgcattgagtccaaatgcgcgcatcaaatgttggttcgtacgggttgtcaccactgaaatcaacgcgctaccaacgagtggtaacacaaagaaaatgccaatgacaaagacccatgtttgccaaataattgtccagctcatggttagtccgccgtgcgaatgtccgcaaacttggcgtggacaaactcagccaattgctcggcatccaaacggattgaacgacccacttcaccagctgacaacgtaatcgtaccggcttccttggcactgttatcaaagtaaattgggaacttcttggtttgccagataccaactgggttattcgcaccgtgaatgtaaccggtcgtcttttgcaaatccttcgttggaatcatgttgaccttcttgttgcctgaaacggccgccaacttcttttcatccaagtgagcatccattggtacgataccgataaccggcccggttacgttcccaatcaacgccaacgtcttgtagatatcatggtcagttaggccataattatccaattcagcttgatcacggttcataccaccagcaaacacaatgctttcatatggaatcttagccttatcaagaatttgctcgacaaggatcttcttaatacgctctttcttagccatgattatctctccattcttcagaacacttctcactaaatctagtacctattaatatacgcttaaatggtgtacactaaaagtccgactaacccttcatgtactttcgagacgtatttctcggcttttagccaggtacatgaagaaaggctcgtacgttttgcgacgtacgagcctttttattttttctatttacttgcgcaattccatttcgatttcttccaatgacttaccgcgcgtctctggcacgaggtaacgaacaaagaagattgagatgaaggcaaagacggcgaagaccccgaatggtccacccacattgttgtggaagacagccaacaagaccaagaagaattgtgataccaagaagtttccaatccagttggcagctgaaccgattgatgatccaattccacgcactgacattgggaagatttcaccaatcaacaaccaagcgattggtccccatgaaatggcaaatccgaagatgtacgttgcaatcaacaacatcgttggaatagcggccgtttcaacagataccgtgtagttcaagaccgtcaaaatagccaaagcgaccgtcatgacgattgaaccaaacgtcaacaatgtcttacggttgaagttatccataatcatggttgccaaaatcgtcaccacgaagttaaccacaccgattccaactgaaatccaaatggcgttggcttcgttaaagccgaatcccttgatgaacacttgtggcaagaagtaaatcactgagttgatacccaccaattgttgcaagaacataattccgatcgcgacaatcacggctggacgggcgattgtgaacaagtccttcaaaccaccctttggttgcttatcaacttcagccatggcagccaattcggcctcgactgattcacctgacttggcgcgcaagtgagtcaaaacgcgctctgcattttccttatcacccttcgcaaacaagaaacgtggtgattctggtagcaacaaaccaccaatgaacaacaagacggctggaatcaaagctgatccaagcatccagcgccagtcgcggatacccatgaagtcgtgacccaagaaaccaaggttagacacgtaggccaacaaaattccggccgtaatcatcaattggaacattgaacccaatgaaccacggtgcttagcaggtgccaattcggccaagtaagctggcgtcaacgctgacgctgacccaaccgccaaccccaatacgatacgcgcaatcgccatcgtaccgaagccagtagcaaaggccgtcatcaatgaaccggcgataaagaacaaagaagccaaaatcaacaacttcttacgaccaaagcggtcagctagcggtccaacccctagcgcaccagccgctgatccaatcaagacggctgacgttacgaacccggtttcagcaaccgtcaacttaaaattgctttcgataagtggcgaagcaccagaaataattcctgtatcaaatccaaagagcaagccacccaatgctccaaagaaaaaaataaaccaaacgttaatcttcattacgttttcccctcacaataagtaattaaaatatctcaccggcttaatataacttacttttcggacacatgcaagcgctttcataagaaaacaggattaaatttgtgtttaatacgggaaaaataaaaaatgactcgtacctcaacggatacgagtcattttcaaaattcaattattgaaaccaatatagaactgtcgcgattgccagcaggacaccggcgatcgtgataattggtcgtcgaatgtccttacccacaacaatcaaagaggtggcgataaatagccccaccaaacttaagatatttctgatcatggtaaagacctgctttgtcgtaattatgattcaacgtgtaatgaacgaatgcctcgtagaatattaccgtaatcctcacgctctagcataccacgatttagctcagttaccgcatgttcaagacgcttatcggcgtcggcaccgaatgacaatccttgttcacgggccgtgttcacaccgttaataacgttcatcgtaaattggtgcaacacttcgatcggtgctaattcaacaacacggttcgtaatcgttggctcaaagtcattcaacatatccgtgatggccataaactcatctggtcggatggcacctgccaccacgatatccaattgttggaagaacgtgatgatttcagggtcgtttgcgaaaccaaacacttccgcttcacggtgcattgattgaatcaattgccccaacatacgaatgtttgagtcacggaatgccggcacaaagcgaatgaatgacttaataactgtctcataatcatcagccgtcaattcttcttctgtgcgctcacgcataccacgtagcgccatttcaatcacagggtcctcgctagcaattgcatatgaatcaacgatgttttcagcaaccttcttaagcatttcacggtcaccttcgaagaaacgcaatggggcaaacatcaagcgaatacggaattccgtcaaaagtgacgctaagtccgctacagtgtcacccaccttaatatctttggcagctgccaaaatacggctgcgatctgcttcatatagctcgttttcacgaacatcaatgacatccgctagcgtatccatccgcgccaatacagattccgcagcctcaacaatggcttcgggatgcaaaacatcacagtcccaaccaaacttcttgctgaccgtttccttaggttcggcgttgatcttcttctcaagctctaaatctgttagttctccaagtccttgcataattttcacctcaattatttggtatctctacccactacttctattaagactatcgtacctaataaatgttgggtaattgatatgaaaatacgaaaaacgctggcctttttcgtaaaagaccagcgtaaatttctattcttgatcgtattgccattcgtctgggaagcggaatgtgccattcgtacgcaagagcgctgatgggtacaattcctttaccataaagaattccggcgtgatttcaaaagctggcttaacgccaaactcagttgaacgaatgtagccgaattggttccagtaaccaggccaaccgatggcagccaagacaccgtatccagcgaaacgggccacaatttcagcttcttcaaccaagcgccagcccaggccacgaccacggtgaagtgggtcaaccacgactgggccgaccacgccgactgctgtgccggtgcgattatctgaaaccgtcgcagcggaaacaatgacgtaacccaaaatttcgtcaccacgcttggcgacaatttcaattggcttacgaccaaatgggttgccagcgcgtaggcgacgcaccaattgttcttcttcgccagtgctgtagttggcatcgtcaaatgcactgcgaataatcttgtcgacttggtcgaaatccttatcgcctaagaattcaaacgtcacatccaataatggatgcgtttcattcatttggcgcattgggaagcggtcaaagatatagcccaattgcttcatgaaacgcaacttttgggcatccccatgacgcaacttttcgctacggtcagggtcgccaatcaagtgaccaaacaagttgtataagtcatacgtcgtgagcacttggaactcaggttcggtgtgcgtaaagatgaattgaccaggcaacttatgaccgattaatggctcaaccgcactttgtggcataaaggcaactgacaacgagtcatcagcgtttgagaacaccaattctggcatgtccaaacgttcaaaaccaaccgtgcgcatgacggattcaatcatcaattcgttgctaataacatcatcatccaaaatcaacggtgccaacttactatccaagtcatagccagacaagatttccaatgcaaatccgccggatacgattggcgtgacattggcttcattcaacgaacgcaccaattgttcaaattgtgtatagcgcttcacatccatttcggtgcgccctcctatctcaaagttcagtactttaattataccccacaaggctacttgtaagcttgccttaactcacggagcatgtctttcgtctccgcgttatagccgtaacggtcgttttccttggcaaccgttggtgcatcatggacatagcccaatccttcgtagaccaagttgcgatacaaatccaagtatggcaagccacgttcttcagcaagggccatctcggccgcttggtcatatgcgactgtgcggaaatccgttgcgaaacgtgtcccttcgatgtccaacatcaagtaacgggcttcgcggttttgacgcatcttacgcttcaatgagaacggactaccaacagaaccagggttcaaaatggctcgaccatctgaagccgtgcgataaatcatttggtgcgtgtgaccataaatggcaacgtcggcatcacgccccaagaatagcgcatcaaaataatactgatcactcattggcaacaattcatgacccgcatttttatttggcatattgtgcgacaacgtgaaggttaaatcttcaacattacgtgtatcggatactggcaatgccatgataaagtgtaatctgcttttggcatgtgttgcatgacataggctgatagacgcgccgtgtaaacacgcgttggcttgttgtaatcgaccgttcgctccaatgctgcgaacatgaagtcatcccagttaccgcgtagccatactgtcacgtttagctcgcgcaacatttcaacaacatcatgtgcaccaggtcctggcataaataaatctcccaagaaccagaattcatcagcaccttgcgctttggcatccgcaatcgttgctgccaacgcggtcacgttaccgtggacgtcagataatactgccacctttgtcatgtcacacacctccatttcgttactgctattgtaagcgcaaaaaagccccaattcccgtgaaaagggaactgaggctaaagagtcacgatatctactttggacggttaaaatcgtgactagctttttctattactaaataaagaagctcttgcgatgcttcgctacaatattagtctacaatatagcgccagcacttcaatctaaagtgctggcgctatttaacttaaatcatcttacgatctgattgttgcaacttcttctcgaaacggcccaacacacggctgataccgaacgtcaaaataaagtagattgctgctgtaatcatcaatggaataaatggcttaaatgaggcaccttgcaccactgacgtttggaacgtcaattcaccaacaccaataactgagacaactgaaccttccttaataaccgtcacaaattcgttacccaaggctggcaagatgttcttgatggcttgtggcaacaccatgaagcgcatcgtttgcatcttcgtgaacccaagtgaacgcgcagcttctgtttgaccagctggtacagcttgaattcctgaacgaataatttcagcaacatacgcggctgagttcaagaacatggcaatcgcaccggccatgaagcttgaaacatccaacccgataacctgcgttccaaagtacacgatgaacacttgaatcaaaagtggcacaccacggaccgcctcaatgtaggccacagccaaccacttcaatggcttcacgcttgaaagcttcatcaaagccaacaacacaccaaggataataccaaagaacacaccaatgaccgccaagccaaccgtgtaaagcgttcccttagcaaagtaaggcgcgtacttttcgaagaatgactccttgtggttcatcaaggcaatcgcttcgttcttccacttttctagcggatcaccgattacgtgcttttccaagatgttgtcgaccttgctttgcaaaactgttgcgttcttagccatcacaactgaagaaccgttcgtttcacctggcaacgtagccttcgcaaccgcaaattggttactttggtccatgtagctgtcggccgtcgtatctggcacaaccacaccatcaaccttgccttgcgtcaattgcgtcacggcgtcgttcaccttcttcaatgacacaaccttcttggcatcaacttgcttggcagcgtcttcttgaattgatgaaatttgagcagccaacgtggccttcttcaagtcgttcaagttggctaacttattcgcgttcttcttaagcgtcatcaccacgttcttatcaacgaagtatggttctgaaaaagcgacttcttgttcacgctcaggcgttgccgtcataccggccacaaccatatcgaccttccccgtcttaacggcaccaagcaacgcatcaaagctcatttcttggacaaccaacttcacgcccaaacgcttggcaatttcgttggcaactgagatgtcaaacccgacaatcttgtccttgccgttcaccgttgtgtggaattcgtatggtgcgtaatccgctgacgttccaacaatcagcttaccgctcttttcgatttttgaaaggaccggatccgtttcggcagcttggacagacgtcaaaccagcaaaggaaccaatcattaataatgtcgccatgacagccgtcatgacttttaatacccacttatgcatataactcattctccctttgtcttacaacatctttgccaagaaactttgcgcacgctctgaatctggattttcgaaaaatgcttctggattatcatattgcgtcatatcaccatcagccataaaccaaatctttgacgctacttcacgggcaaagcccatttcgtgcgtgacaaccaacatcgtcatgccttcttgggccaactcacgcattgtcttcaacacttcaccgaccatttctggatcaagcgctgatgttggctcgtcaaacaaaataatcttagggttcattgccaaagcacgcgcaatcgctacacgctgttgttgtccacctgacaatgacgctggatatgcttgcgctttttcagccaagccaacctttgctaggaacttttcggcaatttgcgtggcttcatcatcagccattcccttcaccttcaacaacgcaatcttaacgttgtcgataactgacatgtttgggaacaagttgaagctttggaacaccatccccatatcttggcgaatcttatccaattcagtttccgtcgcctttgagatatcttgcccatcaaagataacctcacctgacgttggtcgatccaacatattcaagccacgcaacagcgttgactttccagttcctgaaggtccgagcaatgcaatcacatcaccctcttcaacggatgcattgatatctttcaagatgaccttgtcaccatattctttgtggaagtttttaatcgttaaaatcgccataacgttttccccgtttcatattcgatggataaatattaacaggtaacgaaaatttatgcaataactttgtttatttttgcataaatatcactcacgacatacaaaaaacgctactgcagcaactgcaatagcgtttttacccctgtgagagagtttaattattattgggcaatgttttctgaaattgaggcttcgtcttcatgccaacccttagcgtgggcacgtgaacgaagatctgcttcaatttgctcaagtgattggttacgtgtttcgattgtgaagtacttaacgaacacgatagccgcgatacacaaaacagcgtatccgatgaacaatgaaccagttccgaagaagttcaacaatggtgggaacgtcaatgaaacaacggcgtttgcagcccagttaacaacggctccaaatgagttacccaaaccacggatgttcaatgggaatgactcaccgatcataacccacataactggtccccaagttgctgagaagaaggcgatgtaaatcgtcaacgcaacagcacagatgtatgaagcagcttgtgattgacctgagaagtgcattgagaatgacatgatgaacaatgaaatacccattccccaggcaccccaaatcaacatcttcttacggtcaaccttgtccataatcttcatggctacccaagtaacgataacgttgaagacaccgattccgatgtgggcaatcaaggctgcactaacaccgaaaccaacatcagtaaagatagttggggcatagtacaaaactgtgttacatcccatgacttgttggaagatagccaatcccattgccataacaagcactgggcgagccatcaagccgaacaattccttgaatccaccgttagccattgaggcttgcaacttaatgtcagccaattctgcttgtgcagattctgagttgtcttgcaattgcgtcaaaactgccaaagcttcgtcgtcttcacccttacgaaccaagtaacgaggtgattctggcaaggcgattccaccgaagaacatgatgattgaaggcacagcagccaaccccaacatccaacgccatcctagatcaaagccagacaaagcgtagtttgagatgtaggccaacaagatacctgtcataatcatcaattggaacatggttccgattccaccacgcttatcggcgggtgccaattctgacaagtaagttggaatcaaggctgaggcaccaccaacggcgatacccaacacaatacgtgacgcaaccaatagctcaaagttgtgagcgattgatgatcccaaagctccgatgatgaagatgattgatgaaaccatcaacaacttacgacgaccatacttatctgatgatggtccaataattgcggcaccgataacggcaccaagcaacacggctgaaacaacccaacctttttgccactcacccaggtgcaattgcttttcaataaataaaatagctccagaaataacacctgtgtcatatccgaaaagcaaccccccaagggctccaaagaaataaattaaattagtcgaaagcgacttcttttccgtctgcatgtttgttctccctaaacgtaaacataaagcaataggttagtttgccctaaaaactaactctcaacaccctaaatgatacaacttttgaaagcgtttgcaagctttttctcacaaaagttaaaaacttcacaaaacagacaaaaacgagtgtccattactggacactcgtcatttaatgcactagaataccggacgcttctctgtcgttacaaaactggccttctttggtgtgccaaaacgtggctctccattgctgccgaccacaaaagcaaaactggccaacttttgcatttctgccaacacttgcgcacccgttaacgtctaatcgacatctgccatcttcaaaatcgccttttgatttagcttctctgggttagttgattcaaataccatcttcaattccttagtcatgggtcacctcctagaatgctgccggtacgtctttgcgttcagacgtcacaatttccgtaatgcttgtttccaatcctaacaacatcatcaccgttgccaaacgatgcaactgagcaactgaggtcccctttgcaaccttgaaacgacgattgattgccttggcatcgcgatcaagccccaaaatacgcacggtcatacggttatcaaccttcttttccaacttatccatctgtcttcctccttgaattcagcaatgagcatgcggccgcttactcaacttatcagctgttatttgctgacacttatactaacgaatccaaggggttaaaatgtcgcacaaaatgaaaaagacgccacattaacatttgtgacgtctctctatttatgtagatgcgacaaagcatcctcaaatttttcttctaacttcatgccccaggctgtccaagccactgcaatccaggcaacgaacaagaaaatcaccactgccgctgccccaatttctgaaacaaccgcattcaagccaatactttcaaagataaccatgtctaagaagaacaataatggtcctgctaagacaagccccagggtcatcgtcaaagtgtcttcccggcgatcacgttcttgtgcgacctcacatgcaccgattttcaacatctccatcagctcaggtttcgaaacaatctgtaaatctcccgcttcatacgccgaaaattcttgtttaaaagccatcgcgtcctcaatgtgatcaccaatactgaatggcgcaatcagttttgttaagttgggccgtgatagccgcaccaatttttcaatcaaaaaatcagacgtgccatctggaaaataaaacgttaacgtatctttttgctgattaacgacgtagtacataaattgcctccccataaaaactccgaagcgatttgtaccatcattatcctattgttacgtttctgtttcaaattatctgctttagtgaacgcgggcaaccatcttttgacgacgacgcgcaaagcgaatccaatcgtaagcgttaaaaatcatcatgccgacaaaaaagctaacgtacacgcgaccaatcataggtacgatgattgaaaaatccataccatacaaatagcgcattgaaagcatcaagaggccgaatacaactgatgcaagtgcaagcatgaccgctgtttcacgtaaatcttccatgattttggtatacataatcatcaccgtcccatttctcgtaaattcaatataattatcataatcagaaaatgagtttattatttgaaacccatgagaaacgaagaccggcagttattataattccgaaatttaggaacatactttagtcacgaatgatgctaaatacttctattctgcgaatttattacacgcaaaaacccgtcatcttcagccaccacagccaaaaacaacgggttttactaactaaccaattttaatccatattcatggcagaaaatgcaggcgctggttctttatcaccgttagcaatttccgccttcaaacggcgtacaaccttaacccaggctggcaccaagaagaccaatgatccaatccaagccaatgggttcgccaagctggctccaaagaaaccaaaccagacaaccaatgagaaggcagccactgaacggaccaccatttcaccaacaccagcaagcgttggcgtcttaacgtcacccaaaccttgtagcgtgtaacgaagcacgaacaaagtggctaggatggcgtacaacggaccatttgcccagaagtacaattgtgccaaatccataaccgtatgttgaccggcaccgacgaacagcgtcaccaagctgcgaccgaacgcgatttccagaataccaagcaacgttcccacgctcatacccagaatcaaaacaatcttcaccccgaccaagatacgggcgtacttgcgcgcaccgaagttttgcgccgtatacgttgccatcgtcacaccaaatgacatcaccaccataatgatgatttggtcgacctttgacgctgccgtattcgcagcaacagcatccgttcccagcgtgttaaccgctgcggccaacgtaactgaaccaatcgcgatgattgattgctggaagcccattggtacaccggctagcatgtgctgacgcaattcacccttaggcaacttaaaatcagacccagtcaggtgcaatgtatccgtgtaacggctaatgtgccagtgtgacgctgcgattgacacaaactgtgccaaaaccgtcgcaaaggccgcaccttcaacaccccaaccaaacttcaaaatcaaaatcagttcgagtgagatgttgaaaatcatcccgacaaccaggtagtacagtggcgctttactgtcaccaaccgcacgcatggcattagaaatgatgttataacccattgttgcaatggttccagccaagatgatgacaataaacacccgcgcttctgcgaaaatatcggcaggtgtctgcatcaatcggagcaatggatcaatgaacactaagctaataatcgtcaaaataattgacatgataataccagcaacaatactggtggcatatgattggcgcacacccttcatatcaccagccccaaaacgctgtgccgtgatgattgacataccagagctaaacccttgtacgaaacccattaccaagaattgaatcgcacccgtcgctcccacggctgccaatgacgtcacacccaaggtttgtccaacaaccaacgtatcggaaatgttgtacatctgttgtactaagtatccgatcaccaatggaatagtgaacatgacaatcaacttaagtggactgcccttcgttaaatcattcattttatgactactccccctgctaactttaaaccttattaattcatagtatagagtagatttgtttaaaatgtgaactttaacgaaaatagcttgatgctgtaacgttttgtaatagtttgtggtttgtgttgtcgcttacgcgacaaggcatggtggttggtggggctggcggtgctccgtcctacaatataagctggtggcgacggagtcccggtctcactaagcctcagcgtgtttcggcgcctgtcggcttgaaatccactgctgctaagtgattcctggtgctccttccttcgcttagtcaccggctaatatcgcaggagctccgcaccaccagccccaccaaccaccatgccagcagccgagatattctctgttcgttttgttagtcatccacggttcattcgataaggattgctatttcctattttctaaccgtggatgtaaatccaatacagacaagaacatcttggctgctgcaaatgcctggggtaactctcggagcgatttgagctgggacagggaagccctgcccgaccgccgcgtgtctatcggccaaaaccccaagtttcgagtttggccgatgcgaccggcaagggagcaacacgcggtgctcgtggcagggcgtgtcccagatcaaatctttgtcggagagagttgccccaggcatttgctcgtgcgagagcacgacacaaacaccaaaataaaaagcacccacccaaaggcaagtgcttctaattgttattacaaagtaatgttcttctcggcaagttgcttttgcacttctgggtgcgccataaactcgtcgtaagtcgtctcggcacggtcgattgcaccttgatctgaaaccacgataatgtggtccgcaatcgtttgcgcaaacgtgtggtcgtgagacgtgaagatgataccacccttgaagttaatcaaaccatcgttcaatgacgtgattgactccaagtccaagtggttagttgggtcgtccaaaaccaaaacgtttggcttcgtcaacatcaacttagacaacataacgcggaccttttctcctccagacaaaacgtccaaagtcttttccgcatcttcacccttgaacaacatacgtcccaacaaaccacgcaagaacgtgttgtcgctttcttccttagaagcaaagtcacgcaagtagtccaagattggcatctcaggcttagggaagttcacgttcatgtccttagccaagtaatcgtgagacgtcgtaacaccccaagttacttcaccagaatctggcgtgtcgtttccagcgatgatgtccaacaatgccgtagcggcaacgtcgttttcagccataactagggccttctcattagggcgaaccgtgaatgagatgttgtccaacaacttaacaccatcaaccgtctttgaaaggttttcaacacgcaacatgtcgtttccgatttcgcgttgaatttcaaagttaatgtatgggtacttacgcgttgaaggttggatgtcatcaagcgtgatcttttccaattgcttcttacgtgaagtagcttgctttgactttgaagcgtttgctgagaaacgggcgataaagtcttgcaattccttgatttgctcttccttcttggcatttgcttgtgattgcaaacgttgtgccaattctgaagattccttccagaagtcgtagttaccaacgaacaacttgatcttaccgaagtcaacgtccaaaatcatcgttgaaacggcgttcaagaagtgacggtcgtgggaaacaacgataacgatgttttggtagtcggccaagaagtcttccaaccaagcaatcgtctttgtgtccaaaccgttggtaggctcgtcgaggatcaagatgtctgggttaccaaacaatgcttgcgccaacaaaaccttaaccttcgttacttcgggaaggtcggccatcatcgtgtagtgttggtcttcagcaattcccaagctttgcaacaattgtgcagcttcagtttcagctgaccaaccgttcaattcttcgaaacgcgctgacaactcaccaaccttgataccatcttcgtcagtgaatggatcgtgcgtgtaaatctcatccatttggttcttaacgtcatacaattccttgtgtccttgcataacagtgtccaagaccgtgaactcgtcgaaggcaaagtggtcttgtaccaatgatgacatacgctcgttagcctccattgagaccgttccagtcgttggttggagcttgccttccaagaccttcaagaacgttgactttccagctccgttggcaccgataacaccgtatgtgttaccaggcgtgaacttcaagttaacgtcatcgtatagcttcttaccagtaaatgatactgatacgtttgaaacagttagcatatttgtttacgtttccttttctcgtttttaatgtcattgtttattataccgaaattgtgaacatttttgggaattggttttaaaaaacggcaacaagtcgcctcgttgccgtctgatatttaattacgcttatagagtgaggcaaaataaatcgctgcctcgataatggcgatgaaaaatgaaactggtaggtttagcacatacgaaagcaccaacgctgaccagacccccgctactgaaaacagaactgctaggccgataatctgccaaacggtacgtccccaacgcattgcggcgctggctggcagaatcatcaagatgaaaatcaacaatgatcccacgatttgggccgaaaccgccaccgttgttgccatcaagcctaagaacgctacttcaatcagttgaatgttcttcagactaaatactgccgtgtcataatcgaatgcatagtggcgtaattgacggaacatcaataggctagctagtaatactagcaatgccaaaacgaccacttcaatcacatcgacgcgactaatactaaagatggaaccgaataaaataccagttgcggctgtcgcatttttatttgagagtgacaagaatgcaattcccaaaccaattgccaccgcactaacagcagatatcaatgattcagaacgcttttctttgatgcccaactcaccgacggtcattgaagcgaccactgaaaatagtagcatccccaccaacggcgaccagctcataaagagcgcaaatgacgcccccgcaaaaccgatttcactcaacgtgtgggtcaaaaacgacatacgacgcgccacaacgaacgtgccgaccaccgcactcacaatggcaatcaacgtcccagccactaaggcattttgcataaatggataactaagcatgatcttgattacctaccttcaactttgaaatgtcgagattagcaatttcaccaaactcactaccttgtggcgttagcagcaaataatcatctgcatagcgctgaataatttccaaatcgtgactcaccataatcaccgtaatgtcatgatgagtttgataatcacgaatcacatccattaattcaaacttcgcgacattatccaaattagcggttgcttcatcaaggattaagacatttggattttgtaccaatgcctgagccaaatacgcacgttggcgctcaccgccggaagcagtatcaatccgactcttggctaggttagttaagtgggtgtccgccaaaacatggcttagcttctctttttcagttgccgttaaccacggacgcatgccgtgatcaaaactcaaagccacgaaatctgagatacggagcggaaacgcctgcatatctggacgatattggggcacgtagctaatcgcacgtgccacttcggatgtttgccagtcaaattgaccggcagaaagtggtaactggcctaacagcgcacgaagtaacgttgtttttccaacaccattatcaccaatcagtgctaatacgtgcccattttcaagtttaaaatcaacgtttttgtacagccatcggtcgccaaattgcatcccgatgtttgagccagttaataatgtcatttcttcaatgcctcgtctaatgccttcaattgatcgtattgccattcagcgtatgtcttaccggctggcttcgtttctgtcgcttggacaaccggcacaccatgttcctttgcataggtcatcgcttgcttcgccaacttacccgttgactgcgggttgtagataacaacggatacctcgccatcatcgattgccgcattccaattgcgaatatcttcaggggttgggtcttggtgttcattgaccgccttcgagaatgattgattcaagacattggcgcctaaatcaatcaaggtgttatcaaagacaggctccgtcgccatgacgttctttccttgcaagtctcgcttaacctgttgttgcatagcgtttaaatcagtcaaggttgccaaatatttatccgcattcttttggaaataagtgcgctcacttggttctaacttactataagtcttaacaagctgctttgacaagcgcgtcgccacatccgtcttataccagaagtgctcgttaccggtttcttcttcttcgtgatcatggtcgtgtgactcagcgtcttcatgttcatgatcgtggtcatgttcgccctcaaaatcgtataacttggccaagttaattgccttagcatcagtgttttgcttagcgaaattcacgctccagttatcaaaaccaccaccatttgaaatgatgacattggccttttgataaatcttagcatcagctgaagtcggctcaaattcgtgcggatccatatcaggcttgtccataatgctcgtgaccgaaccctggttacccaacaccgctttcgccatttcgccgtaactatctaaactcgcgacaaccttaatcttaccggtttggtcagccttttccgttcggctaatgctcgtgaagataaccataccaatcatcccaacaacggcaactgcaggaatggccaatagccaggggtgcttcttattgttcatgatttcctccatttagtcgatcagcaaccaacgtcaaaaagtgactaatcgttgtttgatcctgttccgtaaagacagcaaaaacactttgatactcagataacgtttcacggtggcgttgcgcgtgggccgtcgccatcgaaattcctaacgtcgtcaatgaccagcgtgacacacgaccatcatcagggtctgggaccacattgaccattggatcatcaaccgtgttgagacccttcatcgccttagtaatcgcggcggctgacacatgcaaggcatgcgcaagctctgtgttggtttgtggtccgttttgggccaacagcatcaacacgtggccttgggtcgtcgtaatgggtgaatttgcatcccccaacaaaatctcacgttgattttcagccaacaagcgtacgtcatttaaaaaatgatccaattgttctgcatactcttcagtcgccataccgtcacctttatcctttaccggttaattaaccagttaagaataacacacgtgacaaaaaattagcaagtttaaatataaaaaaagcgccgacttttacgtcagcgcttagcgttactattgattttttgcgatatccttcgcaatcaaagctgcatattggacagatccagctggattagggtgaacatggtcaccaccaagccaatcgccgtggtccttaacaaaatttgcccaatcaacaatgtgcaaatttggatgcttgtccttttgttgctctaggaattggttattggcttgcacccatgaacgatcggcataaccgtttacccagtaaacattacgattaccgataatctgcatgatttggtcaaacacattttgcccaattgccccgtttgtcccaatcgaaaccacaacgtttggtgccaaaagccccttattaacatatgactgcaacacagttggcacaacataaggttgacgaccaaccgatgcatcagccactgtatttggcatcaattcttgcaaatcaggcgccacgtcaaccatgaccgaatcaccgaccgctgtcactgacaggtccttaattgtcgcatattctttatccgttaagccatatttttgagccaacggatcagaaccagttgtcgctgcgctgcttgaagaactagacttggccgactttttgttgcccttgttatccttcttagctgcttcaagtgcctttttattggcatccgcgattttgttcttgttgttattcaaacgcttttgcagttctgtcttaggtcgcgcgctccctgcttccttagctgaaactgcattcacagttcccaacataaataccgcagcaattccggccataatcttggtcgatttgctttggaagaaatgcgccatttttggctcacctggttgcaattctggcttcttgaaacgacggaagacattttccacatagcgataactcacttcggcgattccaagcaccactgcaatcttaatcacattcatcaagaatgaatcattttgatgcgtgaacttgtcaaagaacacgaagaccggcaactggtacaagtaaatactgtatgaacgcgtcccaagatagttcaacggcttattatcgaggaccttactcaaaaatgaagccggatgcgccgtaatcgcaatcaagcccgtcaccatcaaagtgaacacaaacatcaagcccatgtacgttgcttcccactgaccgttcaaccaaaacaagccaaccaacgtaaaggcgaatgaaattgcacccaacacattcaaatttcggttcgcttttggctttaacgtcaatttcatgtgatttgatggccaagcaaaggccaacgcagttcccaacagcaccgcaaacatgcgcgtgtcagaaccatagtaggtacggttaatgttcgctggatcgtagaaaatgcccatcaagatagctgatacaaccgctaatcccaacagcgatgctgcaatcgagctacgcttaatcttcaacgccaacactgcaaagaccacaagtggccaaactagataaaactgcccttcaattgacaatgaccacaagtgggtaaacggcgaagcaccaccccatgaatcaaaatatgaatcaccgtgcttcgttgcccaaatattgtagacatacgtcatattcgtcaagataattgctcgtaagttatacagcaaatcacgggcgaataaaccaatcatcgtcgctgtcgcaaacagcatcacaaccaacgccgggtacaatcgtttgatacggcgacggtaaaacccaagtaaatcaatgcgcccattgcgatcaaattcttgaattaacaagtctgtaatcaaataccccgacaacacaaaaaataacggcacgcctagccaaccaccgaccagatgctcaggccacaagtgaaagacaatgacgccgattaccgcaatcgctcgcagaccgtcaaagccagtaatataccgtggcttattactactattttgccccatttattattctcttcctaaagtcccaactaacatttacaaaactaagttctatgataccgttatatgccagtgtgtttcaagtgaagacagctatgtgtaaagaaaaacgtacacagttattaactgtgtacgtcataattttatatttagcttaatcaaccactggggccgtcattgaagcacgcaaaacggcttcaacatcagcaggttgcattggtgcgtaaacaccttgcgtcaaaccaccgtgctcaactgctgctgcagccatcacgtcaagctttgactcatcgatgccaacttcaggcaacgtcattggaatatccattgattggtaccaagcaatggtcttgcggatggcatccttagcaacagccatgtcatcatccccttgcaagccccaaacgttacgaccgtattgggcaaacttaggtgccgtcttctcgtccaatgcgtattccatccaacgtggcgtcaagatagccaaaccaacaccgtgtgtgatatcgtagaaggctgacaattcgtgctcaattgggtgaacagtccaaccaactggctttccggcgttttccaaaccgttcaaagccaatgatgatgcccacatcaattcggcacgtgactcgtagttatcaggctcgttgaacgcaataggtccgtgcttgataacaaccttcatcaaggcttcagccaagaagtcttgcaagtcaacgttagctgtacgggcaaagtattgctcaaacaagtggctcaagatgtctgatgaaccagcagccgtttgccactttgatacagtttgcgtctctgctgggtccaagaatgatacttgtggaatcaagttcatgcccgtcgtacccaacttttcattcgtctccatgtttgagataacagcgttacggttcatttctgttcccgttgctgacaacgtcaaaatgtcgaccaatggcaaggccatgtcgatcaatgatgggttcttaacaagatcccaagcatccccatcataaggaacactagctgcgataaccttagaagcgtccacaactgatccaccaccaacagccaagataacatcaatcttgttgtcgcgggccaacttaacaccttcacgtactgaatcaatacgcgggtttggctcaacgccggccaattcagtcacttcaaagtcactcaattggttcataacacgctcgtacaaacctgaacgcttgattgatccacccccgtagacaaccaaaacgcgcttaccaaactttgtaagtgcctctggcaattcgctcaaacggtcgcgaccgaaacgaatgtcagttggcacgaagaaacggaagttctccatgaatactcacctctaatttagaatatgtgattagtataacaaagcaaccaaccttagtcaccaatttttaattcaccagtgaggcggattggcgcaccacattttccgcaggcatagcgtaattcattaagtcgccgttgccgataaatttcatggccattcttacaagtataaatccaataatgcttcggttgtttgcgcaccttggccttggatgtcgccggcgcataacgtaaaccggcaaggcgttgtaattcagtttggaaataccggtctttgtgttgatatggcaaaccttgaatgtgattgtggtagtgcaccaattcatgcttaatgaccccaatcaaattctgctcatcaaactcttcaatcattaaggggttgatttccaaattatgtgtctgtaacacatagcgaccacctgtcgtgcgcaagcgacggttgaacgtcgccttgtggacaaaaggtcgcccaaaatcagctagcgatacctgttcgaccaatgcttgtagttctgaatcggtcatcgccagcgatctcctcgataatttttgggtaccttcgtcggcaacttcaaagcttgccgacgtttggtgtgcttcgttgtaaattggcccagcgtatccgcactcgcttccgtcaacaattcatccgattgccaaacgcttgtctcaccgtaactttgtgcgaattgtgtctcgtaataacgggcaaagtaattcatcaaggcgatacctgtatcactgacgaccacttgtgtctgacgaacagccagcaaaccgctcttcaacaacgtttgtgcgacagcaacgtgctcatcagacaaaccatcgtgatgctcaccttcactaaccagccagtgcttaccacgtttttcaagttgttgctttagtcccggttgtgaccaccaacggagccacgtatacatttggaacgtgaacggttggaaggcttcaccggcgacaattttacgcacccaatcgcctacttcagaggcttgttccaaaaattgcgtttgaagcacgggcatcttttgccaattaccacctaaacgttgtgcgacacgcagcacttgaaaagctggcttctcgtgcgccacaaaactcacatatacactggctgaatgacgcgctgattgcacgctcaccaaatcaacatccggttccgtcacgcgggcagcgttttgctgaataaattgttgccagatgcgacggctcgcaacctcttcgtgattcaagaagccaatcgtcaccttttggtccgccttcgggtgctgatatggctgatagatatccgcacgcgtgtcggtcaccgcaacacgaatcgcaaaccctgcatcttggttacgcccgagtttcacgcgcggtggccgtatttttttataacttgcgacttttctagccatagcaccctcctaaaattgttctaatagtttgtcagatagattggcatccttgagccagctcgtcaaaaattgctcgcgattgcgcaaatacaacttaccaaactcatcgatcaaggcgtggaattcacgggcttcatccggtgtgaagtcagaattcatcatcacaaccttttgaaccttttcataggtcagcttttctgggccacccaagaagttcatcaaacggcgtgaataggaatccgcgataaattgtgcccggccaaaaatgtaaaccagccaaaggtcggcggtctcattaccaatccccgacactgcgcggatacgcttacgcaacgttggtgtatcgagcttttgcagttccgttaggtcaaaatcatattccgcgaagaactgcaacgaggcccgcaagtactttgccttgctgcgatacaagccagcctcaaaaatcaactgttccaactcttcctgagacatggccatcaaagtcgctggatcgaaattcgtttcgcgcccaaccttttcaataactggatccaccgtcttggcagaagcattttgaatcaaaatactcccaacaatcgtttccatccagcgttcagccggccaccagcgttgcggtcccatttgattataaagttgttgatacaacccacgaatatccagcgtcttcatctctcaaatctcacttttccaataataaaaggctagagtttataccctaacctttttacttactatctattatagttcatcatcttcatttgatgttgatgcggtgtacgttgcgcgggccccgtaacgacgttcacgcgttaattcaatgtagaattccgccatcgttgcgttgtagtatggcacaacataaattgctgctaaaccaaacgtcaacgccaccaaaatccaccaaccgataaagctcaattgtagccagaacaagcgcaacttgtagcccgccatcagctcttgtgagcgaagcaagtattcagacaagttcgtgatttcaacaccttgcttgtagtcttctgcgtaaatcaacggtgcttgtgagtaaccgaatgacttaacgattcccgggataatcaaaaccaacgtccacaagaatgtaaataggaaacgtagtccgagtagcacaacgacatcaacaatcgtgctacgtccccagaactttagtccatcagcaaatggttgctcaggcacttccttgttgcgaccccattcaacgaatgcccacatagcgcccaacccaaagacaccaaaagcaatttcaccaaccatgttagtcgtgaataggcggaacaaaaattgtagtgactcaccgaacgtcatcgtcgtttgtgcgaacgataccaccggtgcttggttcccatcccatactgatgatagaatctgccaaatgattaagaacattgacaatttaattgaaacattgaaggctggcccttttacccgattacgagcgcgcgccttcagatcataattagttagcataacccttttcctcataaataatcgttttaatacattatagtgtaccatattccggtataccgcttctcagcgcaacaaaaaaggcagcaagcaaacgctcaccgccttcattagctgggatagctggattcgaaccagcgatacacggtaccaaaaaccgatgccttaccacttggccatatcccaatgggggtcgaacccacactcccttgcgggaactggattttgagtccagcgcgtctgcctattccgccacaacggcatatctaatattaatcggatgatagaaagtttaaaactttcaagggcggtagatgggaatcgaacccacgcatgtcggtaccacaaaccgatgtgttaaccacttcaccactaccgccattatctatcaagcaggggtagagggaatcgaacccccaccaacggttttggagaccgtcgttctaccgttaaactatacccctataatggaatgtattattaaattccaatggcgcgggagggaatcgaacccccgacactacgagcttcaatcgtatgctctaccaactgagctaccgagccatttaacggtcacaacgggattcgaacccgtgatctttcgcgtgacaggcgaacgtcctaaccaactagaccatgcgaccaatggacgttacagggatcgaacctgtgaccccctgcttgtaaggcaggtgctctcccagctgagctaaacgtccattatgttttgtgctttgcgatatctctcgctcaacaacaaaaattattatacataccttctgaacactttgcaaccccttttttaaaataaaaagcacacaatgcattttcattgtgtgcttttcgtatgaaacgttgatatatcaacgtttattattgttcatcttccttcttttttgttggcaagaagaaccatccaaggaacatactgaacaacaaaacagttacaagcgtaaatggttgtaagttccagtccttgctaaatcgtccgcctagatagtatggacgatcccagaatccactacgagcatcattagtcttcgtttcatcatccgacttaattagtcggtcttggatacgagcgccacgggtcgccttaccttcagccaacaaacgttaaccaacataagctgcgacaccttgaactggcaattgctcaccgacttgcgttgccaccgcttcagttgcttgcgcaatacctgaaacttgggttggcaaaataatcgtttcagtaaccgtgtatggcaacatggctgtttgtggtactgattgaccactaccaagcgcctgtacaatcgttgccgtcgttgaaagtccatcagcaatatcctgtgcttcacgcaagagttgttctgcacgttgcgttgcttagttaccaacaacttggtcaacaccaacttggttcgttgctgcgtcaatttgagctggcgtttccgctgtctcaattgctaccagctgagcacgagcatcttcaagggctgattgcaccttgttcaattgatccttggctttagccagcttgtcagcaaggtcttgattaccaggatggttgttaaccaaatcttgcaattgatccacaatgtcttgggcacgagaagcatcatcacgcaactcgttaatcttgtcgcgaacagcatcttcggcttcagacttcgcatcgaccatgtcatcagcaaccgccttcttagcatctgtgacatccttatcatccgccttaaccgcatcggtcgccttttcaccagcttcttgggcgacatcattgattgccttagcatcatcagctgtcttagcttggttaacatcaatcaattgatcaacaatcgtgtccttggcatcctttgcgtcagccaattgttgcttagcatcatccaatgcctgttgaacctcaggcgtatttggatgatccttcgccaattgcgtcaactcatcaatatccttctgaatttgcttgatttcatcatcaacacggtccaattgttgttggatagcatccttggctgcttccttagcatccgccaagtcgtccgctgccgtcgtcttagcattcgccaaatcttggtcagcttgcttacggtcaacatcggcagccgttgtcttatcagcaatgtcatcggtcaaatcagaaacttcagccaaagttgttgcttgagccagagcgtccttatcagcttgtgcatccttataacggccttgtgcttcagtcaattgtttattggcatcggccaacaaatcggcaatcttcgtgctatttggattatccgcagcaatctttgacaacgctgcaatgtcatccttaatttgctcgatgttttcttgaatagcagacaaattagcatcagcttgcttattcgcatcagcaatcgcgttattcaagttatcagcagacttcgcaccagcattttgcaagtcagtatcggcagcttgacgagcagcttcagcagcagccacgtcatcatcccctgcagccgtcttttcatcaacttgcgccagcgtctttgcatcatcaactgttgccaattgatccttagcatcagccaatgctgactcagccttgtccaattggttttgggcattcgtcaacgcagcgccgatttctgaatcacctgggttcttcgcagcaatgtctgacaagcggtcaacgatacgttgtgtctcatccacatcatcttggatagctgcgatatcatccgtcaaatcttgcttagcagctgactttgcagcagccaaattctcggcagactttgcttgggcgtcggccaaatcttggtcagccgtttccttatcgacaccagctgatgcatcatcatggctcaacgcattgttaatatctgtgatatcagccaacgtttcggcattagcaatcgcatccttttgcgcttcagcatctgacaatgagctagttgcatcagccaattgttgttgtgcatcagccaacttgtcagcaatttccgtatcgtttggattatccgtcacaagttgttgcaactgacgaatatcctcgtcgataccggcaatattttggttgattgatgcaataatcttgtcagcattcgtcgtcgccttatcttgcgcgtccgtcaattgcttggttgactcagcttgcgccttatcaacatcatcttgtgcttgcgttgcatccccatttgatagcgttgtttgcttatcagctgaggcaaccaaatcagcaacatctgccaacgtttcagctgacgcaatttgcttagctgtattttgcacgtcagccaacgattgattagactcgctcaattgcgtcttagcatccgccaataagtcggcaatcgtgttattaccagggttcttgtcagccaagtcttgcaaggtcgcaatatcagccgtgatgtctgagatattttgctgaatttgcttaatatcatcagccaaactcgtatcagcagctgccttggccgcagccaagttctcgttgctttgcgtttgggcactcttaacgtcgttatccgcttgcgtctccgccgtcgttgcatctgtttgatcagatgtagccgcttcaactaggtcagcaacgtcagccagtgtttcagctgatgcgacatcggcggcttgttgcttagcatccgccaacttgttttcagttgttgtttgctgtgccttcgcatcagccaacaagtcggcaatcaatgcatcatccggattcttcgctgcaatatccgtcaatgttgcgacatcatccgtgatgtttgccaatgagtcttcgatggccgcaatgttatccgcaatcgacttgtcagctgcatccttagctgccgccaagttttcgtcactcttcgtttgcgcatccttgacgtcctgatcagccgtcgtcttggccgtgtcggccgtcgcttctgctgtttcgcccgttgactgtgctgttgccacatcagccggaatcttggcatcgttaacggctgccaattggtcttgcgcatctgacaaagcatcttcagctgttgtcaattggttttgtgcatccgccaacttatccgcaatctcagtatcatctgggttcttcgctaccaaatccttcaagtccgcaatgtccttattaatggccacgatatcatccgtgatgttgtcgattgacgtattgatagccgtcttagctgctgcttggtcagctgccagatccttggcggcttgggcctgggcatcagccaaatcgttgtccgctgtcttttgtgccgtcgctgcgtttgcaactgccttatctgcaattgcttcttgggaagccacatcagccaacgttgtttcactatcgatagcatcctttgcgtcttgcgctgctgtttgggcagcttgtgcatccgtcaaacgctcttgcgcatccttcaaatcttgggcaatttgatcattggttggattatcggtcgcaatttgctccaaatcagcgatatcttgctcaatttgcaaaatgttatcgccaatcgtcaccaattgttccgtgatctgatccgtggctgccttcttagcatctgccaagttctcagcactcttcgcttgcgcatccgccaaatcttgatcggcgttcgtttgcgctgttgttccagctgccttatcagtcgctacttggtcaactaactcttggacatctgctgttgttgtttgcttgtcgacatcggccaattgcgtttccgcatcagccttagccgcttgggcatccgtcaattactccttagcatcagccaacttttgagcaatttcactatcatcaggattcttggctgcgatatccgtcaattgtgtgatgtcatccgtaatcttcgtgatgttatccgtaattgacgcgatgtcttggttaatcgtgttcgttgccgcttccttagccttggctaggttttcagcatgcttgtcttgggcatcggccaacgcagtagcagcatccttttgggccgtgtcagcagttgtacctgccgtctttgccttttcttctgctgccgtcacttctgcaggtgtcgttgcatcagcaatctcctgcagttgatcttgcgccgtcgtcaacgccgtctttgcatccgtcaaatcttgttgtgccttagccaagtcatctgcaatttgcgtatcaccagggttcttagccaccaaatccttcaagtcagcgatatcttcattaatggcattgatatcatcttgaatgcctgaaattgtttggttaacaaccgtctttgctgccgtttggtcagctagcaaatctgcggcagcagcatcttgtgctttcttcaaatcagtatccgcttgcgtgttcgcaccatcggcactcttagcagcagcagtagcggcatcaacttgatcttgaacctcggccaacgttgtttgatcatccagcgcatccatcgctgcctgggcatccgtcttatcttgctgagcctgggccaattggtccttggcatcagcaagcttgtcggcaatgtccgtgttcgttggattatccgtcgcaatttgcgtcaactcgtcaatgtccttattgatggctgtaatgttctcatcaattgcagtcaattggtcatcaatcgtcacctcagcttgtgccttggtatctgccaaattatcagcgctttgcttttgggcttcttcaacgtcagtttgcgcttggttttcattctcttgcgcttcagaaacttgatcagctgcgtcagacactacatcagcaacatcagccaacgtcgtttgatcctttaccttatccaagtcagcctgtgcttgcgtcttggcggattcggcctcactcaattgcgtttgcgcatcatccaacaatcctgcaatcttctcgtcacccggattcttatcagctaggtcttgcaacgtcgcaatatcatcggtgatgttcttgatgttgtcatcgattgtcgcgatgttatccgtaatcgttgtctcagcctgtttcttagcatcagccaagttttggtcagacttcgtttgggcgtccgtcacatcttgtgctgatgcttcagctgccttagttgctgtgtcaccatcagttgttgcttgatcacgagcagcttcgacttcagctggcgtcgttgcattttcgataaccgacttttgactcgtcgcttcagtcaatgcatcttgtgccgtctccaattgttccttcgcatcagccaacttatccgcaatctcagtatcagccggattcttagcggcaatatctgtcaattcggcaatgtcatcattgatatcagcgatttgattcttgatattgtcgattgtattatcaactgccgtttgcgcagctgcttggtcttcagccaaatcaccactagcttgggccttggcgtccgccaaatcttgatctgccgccttaccagccgtatcagcatcactaacggcgcctgtcgcaacttgctcttgggcagcaacgtcagccagcgtcgtttgtgagtcaatagcatccaacgccttttgtgcatcgtccttagctgtttcagccgccgtcaattgctcctgggcatcagccaacttgtccgcaatcaccgtgttatcaggattatccgtcgcaatttgctccaatgctgcgatatcgtcggtaatcttagcgatatcttcatcgatgcttgccatttggtctgtaatcgctgccgtcgcgtcctccttggcttcggccaagttgctatctgattgcgtttgcgcatccgtcaaatcaccttgagcctttgtcaaagcgtccgctgcggccttttcatcagccgtaccagcgtcaacttgcttctgcacatcagccaatgtcttggcataatcaaccgtgttcaattggttttgcgcgtcagtcaaagcgtcctgggcgtctgtcaattgttgttgcgcatctgctagcttatcagcaatatcttggtcgttaggattgttgtcggcgacctcttgcaattggtcaacgatatccgtaattgacttaacatcatcagtaatcgccgcaacattgtcttgcaatgactccttggctgccgtctttgcgtcagccaagttcttatctgactgcgtttgggcatccgtgacatcattgtcagctgcggcttgggcagtatcacccgctgtcgctgcttcagtcgccttatcttgcgcagccgtcacttcagccggcgtatccgcattttcaatgactgccttttgatcagtagccgtcgacaaagcatcttgggcatcagccaattgttgcttagcatcggccagcttgtctgcaatcgttgtgtcgtcagggttattggctgcaatatccgtcaattcggcaatatcatcattaatttgatcaatgttgtcgttaatatcgctaatcgcttgatcaactgcggtttgtgcagccgcttggtcagtttccaaatcagaagccgccaagtccttcgcatcagccaaatcctggtcagcttggtccttgttaccagtcgttgatgttacggcattcgtcgcaatttgctcttgtgcatcaacatcagctggcgttgtggcactatcaacagccttcaaagcatcttgcgctgccgtttgtgccttttcagcttcagtcaattgctgttgcgcatccgccaacttatcctgaatcgtcttattatcagggttatccgcttcaatttgcgtcaattcggtaatatcgctattgataccatcgatattcttttgaatcgtctccaagtcagcattaatcgcgttcttggcgtttgtttgcgcgtcagtcaagtttgcagctgcttgttcgtcagccgtcttttgatcagcttgcgcgttctccaaatcctgagctgccttttcagcgtctgtttgaccagcatcaaccgctgcctggacatcagccagcgtcgttgcgttatcggcattgttcttttgcgtttcagcatcggccaactgtgtcttggcatccgtcaattgttgcttggcatcttccaacgccttctcaatcaccgtatcacctggattatcagttgctgtttgttgcaagtcatccacaattgtttggatatcgttgatattcgatgtgatgtcagcgatgttttgatccagtgccttatcagctgcatccttggcttcagtcaagttactgtcagactttgcttgggcgtctgtcacatcttggtcagctgcatccttcgcacctgaagctgacgcaccagcatccgtcgctgccttttcagccgccgctacttcagctggtgtcgtagcatcttcaatagctgtcttttgcttttcagccgtatccaatgccgtctcagctgttgttaattggttcttagcatccgtcagcttgtctgcaatatctgagtcatccgggttcttagatgcgatatcttccaatgccttaatgtcatcttgaatatcaccaatttgatcttcaattgttgaaattgttaaatcaaccgccttttgcgcagtcgcttggtcagcagccaagtcagaggctgctgccgtctgagcatcggccaaatcatccgccgctgtcttggcatctgtatcagaagtgtccttggcagtatcggcagcatcagtttgtgtttgcacgtcagcaattgtcgtttgatcagcaatcgcatccttggccgcttcagcagcttctttttgtgcttgggcatcggccaattgtgcttcagcatccttcaacttgtcagcaatcgttgtgttgtctgggttatcagtcgcaatttgcttcaggtcattaacattgctttgaatgctatcgatattctcctgaatgtccgcaatgtcagcatcgattgctgtctctgcggcagtcttggcatcggccaaattgttcgcagacttatccgttgccgtgtctaattgcttttgtgcatctgtcacagccttatcagctgcatcttgatcggcttgggcggcatcggtaatcgtcgtcacatctgccaacgtcttcgcatcatcaactgctttcaattgtgcctcggcatccgtcaaagcgttatcggcaattgtcttttgactctcagcattcgccaaagcatccgcaatcgccgtatcaccaggattcttatcaaccaaatcttgtagtgattcgattgtgtcagcaattgctacttgatccttcttgatttggtcaatatttgcttgaatgtccgtcttggcttcagcttgcgcattggtcaagttgtcctcagattgtgattgcgcggccgtcacatccgtacttacagcatcagctgctgccttggctgcgtcctcatccttttgaccttgcgttgtcaaagcatcaacgcccgctaccgtcgttgcggcatccacggccttcaattgtgcttcggcatccgtcaaagcatcattggcagttgtttgttgcgtaagtgcatcagccaacttatccgcaatttcttgatcatctggattattgtctgcaagtgtttgcaacgttgccacgtcggttgcgatttgcgcgacagagtcgttaatggcattgatattgtcttgaatggcatccttggcagcttcttgagcggccttcaaattggcatcattcttagcttgagcagtcgtcacatcttgtgctgactgtgtgccagccgcttcagcattagcttgatcctcggctgctaccgccgttactgctgccacagccgctggcgttgtcgtgttagcgattgcttccttttgagtgtttgcatcagtcaatgctgcgttagcgttatccaattgcttctgcgcatcagtcaatgcgtccgaaatagtcgtgtcaccagggttgttatcagccaacgtttgaatcgtggcgatatcctttgtgatttggtcaatttgatcttgaatagctgcaatgttgctatcaactgtggttgttgctgcctcttgggcggccttcaaatcagctgctgccaactcctttgcatcagctaggtccttgtcagctgttgtttgtgctgtgtccgcagtagtcgtagccgttgtcgcagtgtcttccaaagccgtcactgctgctactgtggttgccgcatcaattgccgcttgggcatccttaattgctgtttgttgcgttgttgccgtcgctaattgtgacttggcatcatccaacaaagcagcaatcttagtattatctggattatcagtggcaatctgcgtcagctgcttgatgtcgtcattgatttgcgcaatgttatccgtaacttgcgtcaattgatcaccaattgcggtttccgcagctgattttgcagctgccaaattagcgtcagccttcttttgcgcatcggccaaatccgttgttgattgtgtcgttgcatcagtaatttcacttgcagcggctgtcgcagaatcacgtgctgcttgcactgctgctggcgttgttgcgtcttgcgatgccgtcatcgctgtagccaacgctgccaattgcttattagccgccgttaattgtgcatttgcatcatccaacgccgcttgaatatctgcatccccaggattgtctttcaacaattgttcaatcgcatcaatgttcgattgaattgtcgtaatgttggcatcagcagtgtccaattgttgttggattgctgcctttgctgctgcttgatcatctgcaagcaccttcgcagcttcagctcgagccgctgttaccgcgtcatttgcgacaaccaacataccttgcacatccttaccagctgaattaactgctgtttgttgcgcaataactgcttggactgacgtcaaaccaggcacggtttgtgccgccgtatcaacttgcgcttgcgcggccttggcatcttccaaggccttttgagcatcagccaacgccgtcgcaattgttgtattacctgagtaatccttatctaattgctccaatgcggccacgtcatctgcaatcgtgttcgtggctgtcgtattgtcactcgtgaccgcagttgcagcagacgttgcgacttccttagccaaggccaagtttgaagctgcgcgagtctgggcactcaacaaatcgtcatctgcaatcttttgtgctgacgcagccgctgcactgttttgatcagtaccaactacaaggttgttggcatccgccatcgacatcgtgtcactatttaaactttcaagagccgcttgggcttgtgagagcgccgtttgcgcattcgtcaaacgtgtcttagcatcagccaaccagccagcaatatccgtgtcggttgggttgtcagccgcaattgcctcaagttgcgtaatgtcactctgaatttgcgcaatgttgttgttgattgaatcaatattcgcttggacatgcttcttttgtgcatccaatacagcagcgttgtaggccgataatgccgtttgataatcagccaacgtttgcgcatcgttcacagccttcaatgcatcttgcactgattgatcacttgcaacaacaccagcatcttgtggtgcatcttcataagcaaccgtgtgcgtaatgttatcggcaccaaaactacccgcagcaattgatgttgccttgttattatcaacgaacgacaccttgccgtcttgttgcttaatgctttgttcggcataatccgtgaacgcattctgattaacgacatccgttgaaccatctgggtacgttgtggtcatgttaactgccttctgggcgtatgcgaccgtgaaacttggcacggtcaatgcaccggtactagtcatgttgaaggcaccaacaattgtgtacgtgccatcaccgttgtccttgtagtacattgacttcgttgaatccgtatccaacacagttccggcactagcagtaatcttcgccgtaaagccatccggcaccttaattgtgttcgctgaataagccccgtccgtgacaccagtcaaagacgttgccgaaccactaatagccgttgaaagtgccgtctttccggcgtcatgcaagccatctggttgtgtgtaactgatagttgctgtttgtgctgctggcgtcaattggacgtaaaccgtcttatcagatgatccaaatgtcgcagctgacaggtcagccccaagcttagttgtgagccctgaatctgaatagacgccagataccgcaccggtatagccaaccttcgttgcgtttgataaagccgtcgtatagtcagtataatccgctgcgtccgttgctttttgcccatcatagttcgtgccagcagtgccaagttcaactgaaggtacagttgaaataaccttaccgttctggtcaacgaagaccgtcgtcagcttggaattcttggcatattgcacgttaataatgttgttagcatccgtgtcagaaaccgtcaacggaccggatgttgagttcgacgtgccatacgtagttcctacatacgtatatccagaaatggttgctggcgtaaatgtgtgggctgcgccagttggattagttgacgcaccggacgtcaccatcgccaacgtatcattaacgtttgatttgatttttgtgctcgttgaaatcgtgtttccggacttatcttgataattaacggttgtatctgctgtcggcaacgttaagtcaaacgacttaatcgtgacacccttctgagaatatttagttccatcagatgccttaaaaccgactgacatagttgaattcacaccatcagtaatcgtaatattctgcgttgctgtatatttaccattatcagccgagatagtcagcgtaccaacaccatttgcatacgaataggttgctgtcattggcgcctcaagattaggattcgtatttgtgtcgccctcccactcagagtcagtggcactactaggtccatctccaataaaccccatgacatcagcgccgttagtcttatcaaacgaagtgaatcctgtggaaccactgacagtatttaaagttcctgacccgtccgttgttcgaaaaccagcaacttggtttccgtcttttccagtactaagcgtgctaccatcagttgggtttgtcagagacgtagcatcgccttcgttttgccaaaaatcaattccccattgaacggcatttttaattccaggaatttggtttttattagcatcctccccacttccaattccaagagctcccccaccggcaccagacgtacccaattgattcggagaaatcggtgccaatacaagacccaggaaatctccggcaccattagaatcgtgactactcaaaagtcctgaacttccgccagaattatacttcgtcaaattaagattaaacttcaaagtccaactagcagtcatatcgagttgcttattaaacgcaattgcacccgactgattagccgcgccttttgtcaatgtggtgaacgttgcgctaccactgcctaacttcccagaaagagatcctacaccgtcatctgaatttgaaaatccggctcctgatcccgtaaaattctgtttcacttgctgctgacttacattgaacgaatggttctccccattcgcatctgtcacagtattcactgcgtcagctgatgctgagcgcgtgtcaaataagatgtcaccaatctttgtaatcggcgacgcacttttcttcactttcactgatgaacgtggctcattgctaccagtctcattttgaatttcatcaacaatttccggcccgacaatacttgccccaactgtcagtgcggtcatccccgcgataacccacgcggatctctttttcggcatttctgccgcctttgcaaattcgtttttattcattgttcccgcctcaatagtcactcaaatttttgtgtatactaaaaccctaagaatttcgatactttccctactttaaataatacggggctggtttttcttttcagtgatagaaaacagaattaaagtggttaaatttttgtccatatcgcgtgagcaaatttcttgacatctccgaaagttccttattgaattgcaagatgttcacatttcgcctataatatgtattcgtggtataaaactttaaatatattttggtagtgtagccaagtggtaaggcaccggtctgcaaaaccgccatcgcgggttcgattcccgtcactacctctaaagaaaagacccaatcggaagtgtcgctccgattgggtcttttctttttgtcgtgaaatcaaaacaagctcccgagaaatcaattcgaaatctcgagagcttgttttttattgtttacttatcgtcattcttcttgcgcttgataccaatcaaaccacccaaggcggctagcattgataccaaagcaccagcaatcaaaccccgcttcttaacatctgttccgtcagttggttcacttgtttccgttggctcggccgatacattaatcggcgttgcacggatgatcttctcatcagccttcgtaccagcttcgtatggcaacacatttgctccgctagacgtcgccggtgcacctgatgtggccgacgtcactgaacctgaatcagtttgtgtcgtcggttctgccacgtaggcagctgcaaccggcgttacaacgtttgcgtcttgtgtttgcgtcacgacttgatccacagattgtggtgtcgtcggttctgcagttgcgcggtcataagcggtctgtgcggttaccattgcggcactcgcaacattagctagcgacgttgcttcagcaaacgctgatgttgcaaccgcggcggcgcttgaggcaatcgctgtctcgctcgcagccacggcagcggcacttgtagctgctgaggctgcgctagttgcttcactcgcagcactggcagccttagcagcatatgaatcagcttcggattgatcaccagcttgggcagccgatgttgccaacgaggcgtaaatcgaggcagctgactcagcagcttgtgccgtgctatgcaacgcattcgcttcagaagcggcggcgctggcagcttgggcagcactttgggccactgcacttgcacttgacgcaacactagcagcactgtccgcagctgatgcggcactggcagcctgtgatgcagccgaagcgaccgttgtatcagttgtctttgatgccaagttagcaatggcgtttgcttgtgagcgactttggttagccacactgctaattaccgttgcagcacttgaggctgtcttagcatatgaacttgcggcagatgcatcatttgttgcttgcgtagcaaccgaactcgtcgttgccgttgctgagctagcagtcttagcagcatccccagcttggttcatcgcagcttccttatcagccgctgattgtgcggcagccgctcttgatgttgcagcagcggcagtagatgccgtttcatttgcggcttatgccgttgaagttgcacttgaagcaactgacgcagcgcttgaggcggcttcagaagctgactgtgcaacactagcagcacttgaagcaactgcttgggctgaacttgcgacagctgcagcactggtagcttgactagctgctgaacttgcagcgcttgaatctccagcttgcgcatatgaacttgcggcggcggcagctgagctagcaatgtcattagcattcgaggcaaccgttgcggcacttgacgcaaccgcattagcgctcgtggcctgactagcttgactagcagcaaccgaggcagcactagatgccgtacttgcagcgctttgcgcaacactagcagcacttgcagctgttgatgccgctgacgttaccgcactgttgtttggatacttggcagcatctgatccagcattcgttgcgacactttgcgccttttcagcagcggaactagctgttgatgctgtcttatcagcttggctcgcagcctgacttgcgccagatgcaacttgacttgctgttgatgcttgtgatgcggcattactgttgttcgcatccgcttggctcgcagcactggcagcttcatcagcagctgattgtgctgccgtagccgttgaggcagccgaagcggcgcttgtaacaacatcatttgctgagcttgctgtactggccgccgttgatgccgcatcgtttgctgcactagcagcttcgttagcaacactagccgtacttgcagctgatgttgctgtactctgagcagcactagcagttgcagcagcgcttgaggcaagtgacgcatatgagcttgcagctgacgcatcaccagcttgcgcggcacttgaggcggctgacgcagcgcttgatgcctgcttgtcagctgtcgaagcagccgttgcagcgctctttgccacgctattcgcttcattagcaagactagcggctgaactcgccacactagcagcacttgaagcaacactgttggcagactccgcaaccgaagcagcactatttgccaccgaggcagcacttgaagcagcactgttattcggatacttatctgcatccgctaccgcactcgaagctgctgaacttgctaccgttgccgttgaggcggcacttgaagcagcgctagcagttgacttggccgcttcagcagttgcatccgcgtcactatccgtcttgtcggcttgttcggacgtagcagaagcagctgaacttgcagctgttgcggcttcgctagcttgatctgcctccgattgagcaactgcggccgttgaggcagttgctgcttcgctagtagctgtctcattagcactatttgccgtttgggcagcgcttgaagcaacactattcgcacttgaagcagcatcattagcagcactggcggccgtggcggcgcttgaggcaaccgcttgagctgacttagcagccgtggcctctgattgggcaatcgctgcatatgaacttgcggcgctctcgtcgccggcttgtgcatatgaactagccgtcgaggcagccgaacttgcggctgttgccgcgcttgaagcagctgttgtagcactcgatgctgtctcactagcctcagctgccttggccgcttctgaggctgccgttgaggctgctgaacttgctaccgcattagccgatgtcgcttccgaagcagccgaactggcagccgttgcagctgacgttaccgcgctgttatttggataagtcgtggcatcgttagcagcacttgatgcagcattagtagcatctgaagccgctgaacttgcgttatttgctacttcatcggcaactgacgctgcgcttgaggcagcgcttgttgcggaatcagcagcatctgaagcaatatccgttgctgtgttagcaagactagctgatgaagccgccttagctgcttcgtctgcttgtgattgcgcattagcagcagtcgacgccgttgtcgcagcacttgatgccgttgacaaggctgcactggcagcttgactagcactatcggccgcggttgcggctgacgttgctgtactttgggcttcagatgcgacgctggcagctgagtttgctactgattgcagtgatgtcacagcatcggctgcactcgaggcaactgcggcgtatgaacttgcagcactctcatcacctgcttgagcagctgaagaggcagccgttgcagcactggcagctgagttagccgcttcactggcaactgcgtttgcatttgatgcaaccgatgctgcgctttcagccttcgttgcagcactgcttgctgttgaagcagcgcttgacgcaacggcattggcgctatcagcttcactcgctgcagcagatgcaactgaagcaacagatgttaccgcactattgtttgggtactttgctgctgaacttgcggcatccttcgcggctgagttagccgtgcttgcagctaccgatgttccttgtgcagtttcttgtgtttcgtcagcaaccgaattagcaacactcgcactgtttgaggcagtttcagcttgatcggacgttgcagacgccgcaattgatgcgacatcagccaaactttgagcatcatccgcctcagactgtgcatcagcagcaatcgatgccgtttcagcagcttccgaagcaactgcattcgcactacttgctgttgatgctgcctcactagcagcactcgaagcagccatcgctttgctattagcgctttctgcaattgcttgttgggcaaccgcttggctagcagctgcatctgcggctgaacgggcttcgctagcggctgacaagtcacctgcttgcgcatatgattcggcagcactggctgcgctgcttgccaatacttcttgaccggcagccgccttggctgcttctgaagcctgactagcggcatcacttgcaatcttgctttgagcatccgcgacgctcgcagcgctacttgctgttgacgcagcgtcatctgccacgctggcggcactcgttgctgttgaagcagctgatgttaccgcactgttgtttggatactttgtcgcatccgcatttgcacttgttgctgcgctatccgcctgactggcaaccttatctgccgttgaagcagctgattccgtcgcgctggcgttatctgccgtttgactggcaacaacgccagcggcactagcagcattacttgcggcggctgcggctgacttcgcgttgttatccgccgtatcggcgccaattgcttgatccgttgcagcagcggccgtacttgccgttgttgcggcgcttgaggctgctgattctgctgcggttgcaatttcagcttgtgatgacgcgatagcttcagcgcttgaagctaggctagccatcgaactagcaacagctgatgcactcgaggctgtcgacaaagcactggcagctgcttctgattgctcagcagcttcgtttgcagcactagtggccttgtccaaatcaccggcttgagctgcttcgctcgcgacgctggcggctgaactggccaaactagcagcgttacttgcagctgttgcggctgatgaagcagccgttgaagccgaatccgctgttgcggcggcacttgaagcaatcgaggcagccacactggcagcttcatttgcgttcgatgctgttgtcgcagccgaattcacatcatcaattgccttattcaaagcagcgttttgcgcatatgctgaagaatctagcaacgcattcgcagccgaagagtctgcttgcgcatttgaattagctgtcgaagctgtgactgcggcgcttgaagcgttatcagccgacgcatttgcatcagccgtttgcttaccagcatcactggcagcctgaccggcattttcggcatcagtattcgctgagtttgcatcctcagttgcctggttagcctcgtcttgggctttggcagccgtttgcgcatctgccaaagctaacttagccttttcagctgccaaactagcagtcgttgcagctgatgaggcagttgtcgcagcacttgaagccgtttcgttagctgttgttgcaacagccatctcagatactgccgctgatgacgctaccgaagcagcttgggcggctgttgatgccgccgttgaagctacttcagcgtttgaacgatcaccagcttgggcatatgagcttgctacgcttgcctgatcagcggcaaccttcgcttgcgatgcggctgttgaagcatactcacttgctgctgttgcagcactattagcatctagaaccgcttgactggccgttgcattggctgctattgccgttgattctgcatcactggctaccgttgcagctgattgagccgtactattcgccgttgaaatggcggcgttatctggataacttgacgcaatatccgccgctgctgaggcagctggttgggcaacagaattgtaattagttgccgactcagctgctgtgttcgttgcagctgcattcgaggcagtgtctgaagcggcaacttctgcattgtccgcatcgctaccagcttgcttagcttggtcgcctgcggtcgtcgcatctgtccctgccgttccggcagcatccgctgctgcagtcgcttggtcaccggcttgggcgtatgaacttgcatcagccgtcgcatcactcgcttgtgacgctgctgtagccgcttcactttgagctgattgagctgcaaccaaagcatcactagctgcattagcggctgaacttgcgaccttggcggctgactgagcttcagacaatgcttgcgctgctgcggccgagtttgttgcggcagctgatgaattaccaacttgtgccgcctcactggcagccttagcatacgcatcagctgcagctgcggccgaacttgcgaccgaagctgctgaacttgcgattgcattttgggttgtcgcagttgccgactgttcattcgcgacacttgcggctgattgagccgtactgttagcaaccgatgctgtcatcgcagccgactcggcagcgacagcagctgattgcacagcactgttgtttgcatatgcagactcagctgccttagcgctggctgaagacgctgcttgatcagccgttgacttttgagtcgcagctgaacttgccgcgtcattagcttgtgaggtcacattcgcaacatcactagctgtttgtgacacattatttgccgtgtcgctagctgctgaggctgtcgtatcagccgtctgcgcatccgatgcggcactatcggcatcatcttgggcttgagcagctgtttgcgcatctgctaacgctgactgagccacgacggctgccgaactaacgacaccggcagttgaacttgccacagcagcggcactattagctactgaagcagcactttcagctattagcaattcagatgcagcttgtgacgcggcagttgatgcggcagccgatgctgaacttgcagctgatgaggccaatgatgcattagccaaatcacccgcttgggcatatgagcttgctgcactagcttgatcagttgcgatttgcgcttgcttattagcttcgctagcggctgctgttgcatttgacgcagcatcattagcagtactggctgctgattgggcaacgacattagctgatgacacaacttgtgcagctgagtcagcgacgctggctgcgcttgatgctgtgttatttgctgtcgcaatcgcactattagctgggtacttcgttgcaatgctttgcgctttgttagccgccgactgagcaattgcgttatcagcagtagcattctcaacactgacattagcgttatccgctgctgaattggcaccagtcgcttcagatgtcgcattcgttgcatcgttcgttgcggctgaagctgatgaaccagcagtgacagcatcgctaccggccgttccggcggcatcggctgctgcagtggcatcactaccagccgatgcataagaagttgcatcagattgtgcactcgatgctgtgtctgcagctgaacttgccaaagaattagccgcgcttgctgtatccgctgctgtttgagcgtctgcttgggcacttgcagctgttgaggcagctgaacttgccaacgctgcatatgatgaagcagctgagcttgccacttgggttgcacttaaatcaccagcttgggcagcttcgctcgcttgagaagcagccttgcttgctgcgtcggctgccgatgaggcaaccgttgcagctgagttagctgttgaagtcgcttcactagctgaattttgagcacttgaagcgactgcagcggctgattgggcaatgctgttcgcttcgcttgcttgagaggcggccgttgatgcagcactggcgttagattgcacggcactgttgtttgcataggctgaatcggcagccatagaagctgcctcgcttgcggccgttgatgcagtttcagctgcaatcgcagctgaacttgccgtcgattgtgctgcgttatttgacgcagccgtctccgaacttgtcgatgctgtttcagaggcaacatcaccagccgaagtggctgaactttgcgcatcagttacactgttcaaagcactgtcggcggcatcttgggcttgggcagccgtcttggcttcagctagtgcctgttgtgcttcagacaatgcttcactagctgtcgcatccgcacttgcagcggcgctggcggcttcactagcctttatcatttctgcattagccgtcgaagctgcacttgctgctgcgtcactagcggcactagccactgctgctgctgaacttgcggccgaactagcattagttgccgcactcaaatcaccagcttgcgcatatgaggcagctaatgatgattgttcagcagctgttgaagcggctgcatccgcaatatctgcttgcttatcagcttctgatgcggctgcaatcgctgcatcttgtgctgtttgagcatccgaagcggcttgaacggcatcggccttggctgaatttgctttatcggctgccgactgagccgttgatgcagcagttgaaaccgccacattatccttgtaggcactcgaagccaaaatatcagcggctgattgggcagttgtatcagcattagatgctgttgctgttgcttgctcagccgaagattgggcactatcagcatagctagcagctgttgaagcatcatctaccgcttgatcagcgctagcggctgcactatctgccgaaacagctgctgcaataccatcagttgctgctcccgctgcattatctgccgcactgacagccgtggcggtctcagaaagagccgtacttgcggccgtggcggcgctatcagcggcacttgaggcctgatcggcaatcgttgcatatgagcttgcaactgaagcggcatccgacgcggcactagcagccaactgtgcatcactcattgctgccgctgctgcggtttgtgcaccggttgcggccgtggcgtaacttgcggcggccgacttatcaccagcgttagcagcacttgaagccaattcagcatatgaacttgcggcactagcggctgaacttgcggttgaagctgccgttgaagcagcttcttgtgcggcactggcggcactagcggcatcagatgcagccgtagcagcgctgtttgccgttgtaagggcatcatttgctgcagcagccgcactagttgcggctgttgaagccgtcacttgggccgttcatccagcagcactagctgcattttgggcatccgttactgatgaaccagctgtgttagctgcttccccagcagatacggcgttttcagaagccaatgtcgctgcgtcgttcgcattatttgctaaatcagttgctgcggcggcatcagttgcttgagattgggcaaccactgcctgatcagcggctgattgcgctgtcgcttcggcgttattagctaattcagttgccgattgcgcggccgatgcagcggcggcaccttctgatgcggtcgttgatgctgctgccgattgatttgcggcgactgttgcagctgagcttgcagcgcttgcggctgagcttgccgtcacggcatcgcccgcattagcggctgaatttgccactgacgccaatgaagccgcttctgatgcggccgttgacgctgccgttactgcagaagccaccttctctgaagctgcactagcaattgattgttgtgtggcagattctgatgcagctgacttggcaactgcattcgcgctatccgccgtttgttgggcagcactagccactgatgcagctgacttcacggcgtcgttgtcagcataagaatctgtcgcggcaatactttgtgcaacactattggctgaacttgccgttgacgctgctgaactagtgatatcagcagttgacgttgtatttgtcaccgcatcatttgccgtactcgtcgcatcccccgccatacttgtcgcggttcccatgtccgcacccgtgttgcttgcggcgctagctgctgaacttgcgttagtcgcatctgctactgccgacgcaactgtttgagcatttgccaaagctgttgatgcagccgttgacgctgctgttgcttctaacattgcttcagaggccattgtcgctgcagattgcgcatcactagcagccaaatctgcattcgcgctagcggctgatgctgaatccaaagccgcactcgctgcacttgaggcagcgttcacaacatcaatcgctgacatcagtgcagtcaatgaatcggctgctgtatttgcactagaaagttgcgtcgttgcgatagttgctaatgagttagcggctgacgcagccgtcgatccagcagaggctgctgaactagcttgaatagctactgcacttgctgccgctgatgctgacgaagccattgaagctagtgttgaaatttggctcatcaatgattgttgtgagctcaatgcagctgacgaagttaatgacgcgttagctgaaataccagctgctaccgtcgccaaacttgaggcagccaatgctgccgaactggccacaccagctgcactcgcgacaactgaggcagcgcttgaagctgttgcgttttgtgcagaggccacgcttgcttgcaaaccagccgcggcattagctgaagcaaccaaactaaccgccgtcgaagcggcaccggctgcacttgccactgctgaatttgacgcatatgaacttcctgcagcttttgaggtcacgttaacagctgaactcgttgctaacagagctgaatcaatcgtgctgtcagctgtaatcgcactagcgtttgccgtagatgctaccttagcggcattagaagccgtgattgaatcggtcgacatattcgtcgctgccgtttgggcggcgctatttgacgcagttgcagccgacatcgtgatgctagttgcaacagagaatgcactgctagtagctgtacttgccatcgaaatgaacacgtcagcaccatccgtcgcatcagacacgtaactatcaatattggccaaataactattgctcaaatccttcacaagactagaaacaagcacactttgcttattgtagaccgagttgtaagccgagcttgctgaattcataagtactgtgtatgaatccaccgcacttgcattgccgttcgtgttggctgaagctgccaaagcggcataactactgtaggcatttgccgcgctttccatcgaatcaacgccagcatcaaccatcgatagcaacgctgcgcttgaagccacgttagctgctgctgtggaagacgtcatcacaaatcccttagttgccccagaagcccaaatacttgcattcgcggcgtttgaacttgccgaaatcattgattggtcactcgagtaagcactttgagtagccaatgatgacaccacctttgaatatgaggcgacaaccgattcacctgactttgcgtatgaaaccgccgctgataatgaactttgcaattgcgcaattgaactaagcgctgttgcaagtgacgttcccggatcagctactgatagagctggtgaatacacaacatttggtgcaaaattctgtgactggaacgtaccgttaaccgccgtacgatccacaatataaccagaaactgacgccacagaatatgaataacttgttccattaaccccggtaagggttaccgctgatgaagatttcgtaattccttgcgaatctgtgtacaacaactgaatagtcactgaacgttcagcaatcgtgttatacaaactcgtcgttgctgattgagcgctcaatgtctgcaattgcgcggcagaaactgctgcaatcgctgaacttgtcacgaccatcaaactcttggctgcgctggcatagctttgtgcgtatgacacttgttgactgtatgatgctgaagccaaactaaatgatgcaatcgcatcagccgctgatgacacttgtccggctgcggccatgcttgaagcggcagctaaataagatgacgctgaggctgacgtaatcgccgccgcagattcaactgaagacgtttgggtatacatgtttgaagcagctgatgcagccgacttcgcaattgctgtattcgtcgacgctacaacattcgcactacttgcaatcgcagcaatcgaaccaatgcttgaggcaacagaagcgactgatgagttactactgtacttcgaagctagcgaactggctgatgatgccgtttggctagctgatgaggcttcaacgcttgctgaagaagacttcgccgcactcgttgctgacgaaatcattgaacttgctgacgaggcatctgatgacgctgaactcgcaacgctagaagctgcactcaccgactttggcaaaaccgtaacagttgccattgagctagttgcattaccagccgcatccgttgctgtaatttgaacttgatacgtgcctgcagaagcggtgttgatactgccactcgtcaaactcgtcgtcacagcctttggtgagttgtcccccaaagatgtcacaaggcgattgaccatgtcagagctgttaatcgtctcgttttgttggtacgtaaccgtattcgtcaacgacatctttggcgcttcaatatccttatattgaatttgaatattgttgtttgatgtagctgatgtcaccaacaagttagttgtagatgtcaccaacgcacttgtattcgtgttggccgcatatgaaacggcgactgctgaataacccgaaatacttggtgcagcgaaagaagccgtcgcatttgtcgcgattggcgttggggtacctgtaattcccacagctgtccaattttgggctgtgaaactagttgctgaaatcaaagctgatccgaaaccatcaacgtaagtcacgttaacaggcgtcgttgcaaccgtacgttgaatagacgcaattgatccggtagcagttgccggcgatgtggcgcctccattgttaccaaccatttgcataacaacgttcttaggcagcgtcactgttttcgacaccgtcttttgcgtatttgttgttttcgcattcgaccctagtgccgtaattgtcatcgttccagtagcagaggtcgccgtaactgacgttggtgcccacgttactgaatatgaccaagaagcatcatctgattggctaccataggcaattgaaaaaatcacttgggcaaaatttgctgaattagtatccgcaatcaaagacccactagcattagtttgacgaatacccaaggccgttgtttgaccataggtattaccagtttgatcaaatgccgtctgagcatcttctgccccgttataatacaaatccactccagcgaacgtcgtattcaccataggattggtaaagagatttccatttccgttgttagtgtatttaccaccttcagcaaaatcgggcgcaaaagccaacccaatataatttccggcctgataacgatttgttgtaaatccaccgcttatggtaaatccagcgcccgtatcaatcgcttctttgtactgtacatttccgaagccattttgtgttccgttcaacactgtccaactagtgccgctcgccgccgcatttccaccaatagctcgcattgatgcattcgcttgcgcagtcgttaacgttcccgtctggttcgcagttgacgctactgatgcaaccccagaattcgtcactgtaacagcagtcgttgtattaaccgcagcggttgcggccgaagcagcatacgcaacaccaccgccaatagcctctcctgctgtttggtaaacttccgacatcaaagtcgtcacgtcttcaggcgccatcgccgtggcaccaccaacggccaaggcagtcataccggcgataacccagcgctttttagacttatacatctttttgtgtgtttgcggttgcacacgcgcttcgtcggccaacttttgttgataatcttctcgactcatatcttcatcccctctatataatcgatttcgtgatgaaaattcacttttccaccctgcatcgccagtttctcaaaaagatatggtcgttctgccatcatccgccccaagattttatgaataactcgcgattaaacacgttaaccaacattccgattaatcgtactttgttcaattttagttgatagttatgaataaagcgcttccaaagtttcgggaatgacggcaataaaaaaagattcaaacccgtaggtctgaatctttcatcgttcttactgtaatgcagcttgccaaagtggcatcatctcatcagctgagaaggtttgtgccttgcggtaagcaccctcagaaagggctgcccacaaaccagtatctgacaaaatcgccgttaagcgatccgccatatcgccatgcgcaccagctggtacaacataaccattcatgccgtcatcaaccagttccttcgtaccgtacgtaatatcataagatactaccggtacaccgtaactcattgcctcaaccaagttcataccgaacccttccgcaactgatgtttggacaatcacttgtgcctcagtgtatgccttggctagcttttcaccagtcacataatcaccgaagataacattttgttcaacatccaattgcttagccaacgccttcaattcattcaaaatatcagcattagatggataaccgtggaatgctaacgttgcatctggaattgactttaccacacgcgccaaggcacgaattgcttgatctggacgcttctccggtgaaagacgaccgacataagcaatgcggtgtgaaagtcgttctggcaacttcacatgttcagcagccaagtgggcatcatccacaaatgtatctggcgcaacacggaatgtcacacctggatagcgcttttgcaaatcttgttgttgttcaacggttgggaccaagatagcatcaaaatccttaacgcgacgttccaaaacgttcaagtaggcatcgtaaagcttaccgcgcactggattcttgatgtcaggtgtgtgaatgtcgtgcaaaaccgcaaacttcttagctgcaaattgtacatccgccaccacgtgatccaaactacgacgatctgaaaccaacgtagaaccaggattttcgtttgttagctcattcaagaagaacaagaacatttgatcttccgtgttaaaacgccaatcgcgtcccttatagttcaacaacttgtacatcgttggcaaaatgttgccattcacgttcatgtgcatcacttcaatcaccggcacaccgtcttggttcaagaacttttggaccgcaagcgcaccatttggatggaagtaatcaactgatgacttaaagccacgccaatcataattttcacgggcagccgtgttaccaaatcggtcgtagtagagaatatcattcactagcccaaccgttgctggcatgacattgatacgagccaattcacgacctgcatgattaattgttgagtaatttggtccgtgaccctcaatgtgatactcatccaatggaatttggtccaacaaacgcaatggttgttccttgcgttcaacggccgtcgttccttggaagtagtcatacatattaagtacttcgtcttggtttaagccaattgatgctgcatcacgtgccaaaaagcgattgtaattacgcgtcacatatagtgccggttgtccttgggcattgaacagctgcactcgctttacttgtgagtgctcagtccctgaattaaatgtaaaaacactttcactaataaaataattcattgttcacactcctactttgcatcatgggcatgtgctggcatagccgccaacttagccggccaaacgcgctcagcatcatccaacaaaccgcgccatgcttgccatacattttcttctgaataacgttctgaagaatcatatgcgcccgttgaatattgttgtgccaactcagggtcgcgcaacaccttcaacatcgcttcggccattgcttgatagtcttcgtatgggacaacgtttccgttgacgccatcttcaacaatttcgtttggtccataattcacatcatatgaaaaggcaatcaaaccgtgggaaatagcttccatgatggccaagttgaatccttccatgcgtgacgtcaaaccatacatcatggcattgttttcaacggcatcaatatctgtcgtataacccttcatcgttacgacaccatccaagttgtattcgcgaattgcttcttcaaccgcagtacgtgccttgtagttatcagtcggatccgcataaccatacaaatccaatgtgacttgtgggaattccttgtgcacgataccaacggcacgtaccaagtcatccaagtgcttttcccaagcaatacgggcaaaggcgataaccttaccgaattcacgttgtgcaactggtacacgcggcgcattcaacaattcatcaggcacaaccccgaccggaattgtgaagagctttgtcttaggttggaaacgctcgttcacatcatgcgtttgcttgtgtgtcgctgagacgacagcatcgtattcattcaacgcattcatcgcaaactcatagtggttgttcaaaattgaatgcattggatcttgcgcatccccagcatgagaattgtgcaagtgcattgcgatataagctggcttacgcaaacgcaaaagtccccaatcacccaggtgtgaacgatccaagacaaacacgtttggcttctcatcctgccagaagtcatcattcaaacggtcgaagaagtgcttcgtcaattcttcaatcgtatcgaattgcaacacgtgaccattgtgttcaatcaaacgccagcctgacttcacaaactcaccagccatcgtattcttgttgaacgtctcaataacggtgcgtccttcaggcgttacccaagtttccgtcccaatcttgttgtcaggtgtgtaccattgcaacaatgaggcaaaacctcgtgagtcatagtggtcaacacggaacaagttgttgtagccatcaaacaattccgttgaacgaacgcgacgatcagcggtcgcatcataattaacacgcgctaccaattgcccattttgtgcatttaccaagtaacggttattctctggttcatcaaccaacacggttcctggcacaccaaaatcaaggtcctcagcatgcaacgtcttcggcgtcacagccatcgcctcttggaagtaatcaaacatgttgatgagttgctcatccgaaatcccggctgcattcgcattaatgtgggcaatcggatcccaatcgcgcaaaacaacacgtgaatcttcatgatgattattaaataattcaaaacgctttagttgcgcgtgctcaataccagatttctggtttggcatcgtcgcattaacgaagaaattcatagtactgccctctcatgagctttatattagtaattaaatattattatccctattgtaacagttatcatcttaaacaaaccgtattatcttgttgcgtattttgtatgaaaaaaaggcaacctttcagtcgcctttcatcgtttctatgcatattgtgcccaaagctttaccaatgcttgggttccctcgtcgccgagattcttttgttcaactagcttcgtgtacaaagcctcagccaaatcagtagctggcaaagacaagtccatcttagcagcttcatccaacgcgatacgcaagtccttcagcaagtgctttgcgtagaaaccaggttcgaaatcacctgccaagacacgtgggccatagttatccaatgaccagttttgtgcgccaccagcagccaacgtttccatcaccttggcaacatccaaatcagcagcctttgcgtaaaccatcatttctgacatacctaacatcgtggccgcaatcataatttggttagccatcttcgtgtgttgaccgcgaccagcgacaccaaagcggttcgcagcctttgaaataacatcaaaaattggttgcaagctatcgtaggcagcttggtcaccaccagccataatcgtcaacgtaccgttcttggcaccaacatcaccaccagaaactggtgcgtccaataccttaaccccgtacttctcaccatcagtagccaattgttcagccaaagttggtgttgacgttgtcatatcaacgaaaatttgaccagcatgtgcaccagcaaatagtccgttgtcaccgtagtattgttcttcaacatccttagggtaaccaaccatcgtgatgaccaagtcggctgcttctccaatcgcctttggaccatctgcccaggttgcaccgttatccaacacggagtgggcgtgggcttttgtacggttgtacacaaccacgtcgtaatttgctttcaacaagttgttgatgatgcctcggcccatcacaccagttccgataaatccaatcttcatctcgcgttacctcacttctattcgtactgtctattgtacaccgccagcaaaaaagaccaagaacttatgcccttggtccaattaatagctaatcttgttcagcttgtttgttacgccaagctgtgaattttttcatcttcacccgattaatttcatcacggagttggccaacttcattgggtgtccccataccgtgccaaataaataccgtgcaatctaaatcaacaggttgcggtgtatccgtcagcaaaatatccgtgtgctcggtcaacaaatgattaatctgtaccttgtagcctgggaacatctgcaatgactgtgccacaacgcgctcaaggctttggtgtgccccaaaatcaatcgttaaattaacaattggcaagcgatcataaaagtccgctgacatcataatgactgccatcaaatccggcaacaagaagtttttgtaatctgcctcattgtcgccagtttcaattgcaaagcgctccaacacatcctcagagaattcgtaggccattggaaattctggcgccaactgttcacgatccatcatgtaatcaaagtcgtcatccccggtatatgggaaaacaaggtaacgcaacaacattggttgcattgaacgcgtcaccgcacgaattgattcttgacgaccacgatttttaaacaagcacaagtatgcatcatggagtgccttttcaaatagacgccagtgcgcaattgattcttcactcgcatcttcaaattccgtttcatgcgggaaaattgatagcgtatgaagcaccaaaatgataaagcgagcctctgcctgaacttgttcttccgtgatatctggcaacttacgcaactctgcgctcaaagccgaaataatacgttggctacttgaagaaagttgctcagttggcttcaaaaagcgatccgccaaggctgcatccacatagtgacgcccttttagtcgtaaccaccaaatcgcatacaaatgacgcaaactaacaacttgcgtctcgcgtaagtatggacattccggctcgatcaactgcttaatcgattcacgagattgttcacttacttcttcagggaacggcgattcacgccgaccattgtaataagacaatagttgcaacttaaacaaacgaatatgcgcttcgttcccaaccaattgataatccttagaaatttcaattccttcacgagcaagttcttcaataactgccgcacgttccttgtacatctttggcactgagacatcaaccttaaatgcgaaatcttcccaagatgtaatgcgttcatggaacaggtcattaatcatctgcccacgaattgaaatttgtaggtagtgcaatcccaacgcttcccaatccaacaattgaattggtagcttgaagatgacatctgatccatcttcaatcacaatgctatcgggaacccctgtgagaatctcgatatcaaccactaattgctcgaccgttgtcgtcaccaaataacgtgacaaatctaaatctgtcataatttgtgtaattggcgcttccccgttctccttaaggtagcgaaacatcttcaacttattacggtcttgcttttcatgcatccatttcattttactcaccacaacccacattaaccaaacgttctctcaatgagaagatactaacatttatactaaatttctgccttatttaaatcctgacaagtcattaaatatcgtataaaaatcggacagctatccaattaagttgtgatttactgtacaattaagaggactgaaaaaacgagttttcttgggggttacatgctatttattgcacttttggcagttgttctgccattgattttgttggcggttttcaatatgccagctatgaaaggaatggctatcagtgccgcggtcgtttcactggccggatggttcttctggcacattccaactaacgtcatgttggcatcaattttgcaagggattcacaaaacatttccaattctatggattttgtttggggcattgatggtcttgcacgtcttgcgtcacaccggtgctattacacgaatcaacgctggtttcgaatcattgtcagctgacatgcgtattctggccgttttgattgcctacctattcggtggtttgattgaaggtgtttctggatttggaacaccagctatggttacggcgccattgttgatcgctttaggattcacaccaatggccgccgtaacgttggccttggtcgctgattcaacttcagccgcttatggtgctgtgggaacaccactaacggttgggttgagtaacgtggcgccatcaaccgcgactgatttcatgaatgaaattgcacgttcaatgaccacgattgatttgttcggtggaacgttcatgccacttatgttggttattctgttagtcacattcttcaatcgtggcaaaaaatcagcccgtgactggttggagatgacaccatgggctttgttcatcggtatcgcctacaacggtttcgcttgggtgtatgcgcacctcatcggctatgaattcgtgtcaattttgacaccgctaacattgctaattattgcggttatcacgcttaagacacgtttcttgttaccaaagacagcgttcacgaacccttggaagggtgcgaacttcgctggcgatggtgtccaaaacgacgaagaggttaatcaacacgcatcaggaaatatgtcattgttgacagcctggtcaccttacctcatcgttgtggtgctcttattgctttcacgaacgatcgtctggttgaaggatttcatgaaccacgccattgatttgggttgggtaaacattcttggtatcaagggtatcagctcagattggccagttttgtactcacctggatttatcctaacgctagctgctttaattgccttgattgtccaagcccgtacaatcaagccattcgtgccagctgctaagactgtatctgcttcaatggtcagcacgggaatcacattgatggtgacgttgattatggtgcaagtcttctctaactcagggatgaataccatcgacatgccatcaatgccaacttacatcgccaagactgtgtctgaacacatggctggcgtttgggtattcgttgccccattcttgggtgaacttggtgccttcattactggaagtgccacagtttcaacattgacgttctcgcctatccaagccgacgttgccgcaacagctcacttgtcagcgccaatcatcttggccttgcaagttatcggtgccgctgctggtaacatgatttgtgttcacaacatcgtcgctgccagtgccgttgttggtttggctggtaaggaaggcgcaatcttgcgtaagacagccatcccggccgtcgtttacggtctattgatcggaatcgccggtgctgtgatgctagtattctaattatcattcaaagtccgttgcatttgcagcgggcttttttatgttaccaaaataaaaaatcaacaatgaatcagttgattcatcgttgctctatgctctgctttttatggcaaatcgtttccggctgcaaagtagatgtcgtaccattcttggttcgtcaacgttaccttatcgccgttcatcatctcgtccaaacggttcacgttcattgaacccaaaataacttgcatcttagctgggtggtgcaaaatgaaggccacggcaatcgtgttcttcgttacaccatacttgtcagccaattcttgcaactttgcgttcaatactgggaacttatcgttgtcgataaatggtccctcaaagaagccgtattggaatggtgaccatgcttgaatcgtcatgttcttcaagcgtgagtaggcaaagataccaccgtcgtggtcaaatgaacgctcatctgacatgttcacgtgaatgtctgagtcgatcattcccgtgtgcatgataccgaattgcaattggttggcaaccaacttttgcttcaatgaagcttggaccaactcaacttgccatgggttcatgtttgatgttccgaagtgcttaaccttaccagatgcttgcaactcatcaaaagcttcagcaacttgctcagggtccatcaacgtatctggacggtgcaacaagaagacatccaagtaatccgtttgaagacgcttcaattcttcgtcaacggctgagatcaagtgtgactttgagaagtcataacgaggtcccttccagccgtcacctgaaatttggccatcttcaagaatgatgccaccctttgattgcaagaagatgtcctcacggtttacaccggcatccttcaacgcttgccccaaaacaactgaactcttacctgcggcgtaaatgtcagctgtgtcgaagaaggtcacatccttttccaaagccttctcaaccaaagcttgtgcttcagcagcagacttatcagcaatacgcattacccccaaggcaacgtcaggaacgattagtcctgagccacccaaatcaatttttgccattgatactcacctccatgtgtatgcccccagtctactcttcttctttaaaaaagaccatgatcatctggtgaatattcatctcgaattaatccgcgaagataacttctccatcttcaaaggcggcaatgcgggccaatgattcaacgcgtacatcacgttcgtccaacaaagcacgccccttttggaacgtcttttcaatcacgatgccgaccccaacgacttcagcaccagccgcttcggcaatttgcatcatgccctcaaccgcttgaccatttgccaagaaatcatcaatcaacaacaaacgttcgcccggttgaatgaagcgcttatcaacaataacgtggtttatttcttgcttggtgaatgagtagacatccgccgtgtagtggtcctcagacaacgtgagtgacttcttcttacgcgcaaacaccattggcacgttcaaggccaatgccgcaaagacagctggcgcaatccctgaagactcaactgtcaacaccttttctaccttcgcatccgcaaacaaacgggcgaattcatcccccatcgccttcatcaaagccggatcaacctggtgatttaagaagttatcaaccttcaacacttccgttccaatcacacgtccgtcttgcttaattcgttcctctagcaacttcatcattcatcccctgtttctttttcacgtcctggcaaaacaatgtttaagaacaccgctaatactgacgttacaaccactgcattttcgataaccaatcgaaccaactctggtaagtgttggaaaatttgtgggtaaaccgttaccccgataccagccccaattgagatggcggcaatcatcaaattacgctccttggcaaagtccaccttgcgcaagattgtcgttccttgtacaccaatcgtaccgaacaaaatcaccatcgcaccgcccaacactgaggttgggataatcgttgctaaagcaccaaactttggcaataacccaatcaacaacagaatcccagcagcgtagtaaattggcgccttcgatttcacaccagacaagcgcacaaccccgacgttttgtgagaatgttgagtatgggaacgtgttgaacaaccctgataacatcacggccaaaccttcagcacgatatccctttgccatatcattattcgttaacttgcgacctgttaggtcagccaaggcgaagtacacaccagtcgattcaatcatcgacgtcaatgcaattataatcattgtgacaatggccgatgagtggaaagttggcgttcccaagaaaaatggcgttggcaaatggaaccaagatgcttgtgcaaccggcgccaacgaaaccataccgagcagacccgcaaacattgttcctagaataatcccaagcaaaatcgaaattgctttcgtaaagcccttcgctagcaagctgaccaaaataatgacagccatggtaaacacaccaactgacaaattagctgcgcttccaaatgactttgctgcgacatcaccgccacccaggttttgaatgccgaccggaatcaacgcgaacccaataactgtaatcagtgatcccgtcacaaccggtgggaagtattcacgcaaacgcgcaaataagccggcaatcaagaacacaaaaagccccgctgaaatcgttgcaccgtacatggcgccaatgcccaacgtactaccgatattaatcaatggcgtcactgactgaatagctgatccaagtacaactggcatcgcaataccggtgaggcgtgtgctcttaagttgcagcaacgttccgatacccgtcatgaaaatatcagctgaaatcagatacgccatttgctgtggcgagaaatgtaaagccgttccaatcaataatggcaccaaaatgccacctgaatacatcgctaagacttgttgcaaacccaaaacagcttcttgcagcttcgacgtcttagctttcgttgtaaccccaacttccgtaacggcttccataataaacaaacccctccatctcttctgtgtaaccactaccccaactcggtgattcgatagaactaaaaagcacccattcacacgcaaaaaagcatgcagaatgggtgcattagaaatctcaaaacactatcggtagtccgtctcttgggaaacgggtaggaactcgctggccattctccagcaattataccgatagcgattacgttctcatttgtttcatcaaatataccaaaagtacgcgaatttgcaagcgtttttcagaaaatcgctactcaaagttcgtgtttacatgtcatttctggcatgattccccaactttttgcgggtatagttaagcatattaagtattaaaaattctaggagaaagttgcatgcgtcctatcgagcctcacaaacgaacgaaccggttacctgccgtagttatcttttgcctcatcttaatgacgggagcaattatcacggcggcttattttctagggcactcaaacggctatcaacgtggtgtgttgcatggtgccgaggaagctttgacggtgcaatcgtctggaaccaaaaaggaagatagtagtgcaatgttggagaaagctttgcaaaccgccgctacggctgccaaagtgaatccagattcagtttccgcaacgaacgaagtctataacccaactgatcgaacggtcgaagtaacgtttgaagatggcgaattaacgcacacggttgtggttagccgtgactgcaagacagtcctgtcacacaccagcgcacctgtacaacaacaataaataaaacggccaggaaataaattcctggccgttatttgtttagaagaaatattccaaatctgatgctggcgttgggtacgcgtacaagcgatcacggattgcttgatagccatccttgttattaattgcttcagtgaagtagttaatcaactcatcggcatgcgcactcaagaccgttgccccaaccaacttcttgtcggcatccaagacaaccttggcacgggcagctggctcaccggtacggtaatacgtaaaccagttcgtcatgtcgatatcacgcactgagtaaccgttttcctcggcatattgcgttggcacaccaactgcagccaacttaggcgtaccgtaaaccacaaccggcaccgctgggtattcgattggttggtcatgacctaggataactgatgctgcataacgtgcctcgtagtaaccaaccgtcgtgatacgtggcttgctggtgttggccacgtcacctgctgcatagatgtgtgggtttgacgtacgcaagaattcatcaacgttaataccgtggatatcgtcttcgacaccggcattttccaattgaagcgtgtcattgttaccaacacgaccaaccgcgcggacaaccacaccagctggaattgtgctaccaaaactcaacgttgctgagtaaccgtcatccgtcttcgacacttccgtcacttcagtgttgaagtaaatgcgaataccgcggtcatccaattgatcaaatagcgtatcaacaaacgcctcgtcaaattctgacaacaactcactaccacgaacaaccaagtgaacttgtgcccctgcagcagctgtgattgatgcgaactcaacagcgatgtaaccaccaccgataatcacaatatcttcaggcatctcagccaagctcaagaattgctcagaattgattgtgtattcagcccctggaatttccaattcagctggtcgttggccaaccgtcaaaatccagtcagttgcttgcacttcaacatcttcatcgccgtgcacaatcactgtatcttcattaataaagtgggcagccccgtaaatgtgaccaatgccgttagcatccaatgaatgaaccgtcttgtccggaattgcttctgtgaagcgcatcttacggcccatcaaatcttcccagttaatatcaaccttaccgtcaacaccatccccacgtaggaagtctacgtgttccttggcttcaacagcggccaacaaaatcttcttaggatcgcaaccataatttgggcatgtgccaccccataggtacttttcaatcaaaacgactgacttacctgcagccttcacatcttccgcagcggccaaaccggctggcccagcaccaataattgccacgtcatagtgtaatgtctctgccatgtcttactcctcgttaactttatttttgtaactctattctatcaggattgtctagtgacttctgattagatgtattgcaacaaagtcttaacgaagtgctcaagctcagccttttccttagccccgaaacggttgaaggccgttgaatcgatatccaagacacccaaacgcttaccatcagccgtcgtcaaaggcaccacgatttcagcgtttgatgctgggtcgcacgcgatgtgaccgtcaaagacgtgcacgtcagcaaccgtaatcgtttcttgcttctcgaatgactcaccaactacacctgaaccgggcttgatgcgaacaaccgctggcttacccaagaaaggtccaagaatcaattcatcaaccttttcatcatacaagtagaaaccagcccagttaacttgcttcaagttttcaaacaaaattgctgaggcgttcgccaagtttgcaagtgggaacttttctgattcttcacccttaatccactcaatcaacaactttgaaatcaatggtgtcttcaacaatgtatctgcttctgcgcgtgtaatctcaattgccataatctatatacctcgtttattaaatactctctattttcgtcatgaatgcggtgcctaaaagaaaaagccgcccctagccagaataatctctagctagggacgcctttaatcgtgttaccaccctaatttatgtacttgtcaccaaatacacctctacagttcgccgcacttaagcggataaaccagggaagataacggttcctaccgtggcatcagcttgcaccgacgtcatttctccgagctcatcttcatgccttgaacgaaacgatttcacatcaaccaatcgctttctgggttcatccgtaacactactcttctcatcaccgaattcatgtcttaacttatgtgctttatcatacacactaaaaattagaatgtcaacaactaatatgagagttctttcatattagccaacatattcattaatccaattttgaacgtcctttggatacaaacgttcaccgttaccaatgtgggcaacttgttggccgtcttcaaacaagacaaatgctggaatccccatcaaaccttgttcttgtgcgattgccaaattagcatcacgatcggcatcaacccaatttgccccaccgtcagtaacggcatccttgaattgttgtacaaacggcttgattgccttgcagtctccacaccagtccgcttgcaaaaacatcacttgcttccctggttgcttaataactgattcaattgttgcatcatcatttgctgttggttcataaaattgcatgtttctttcccccgttctttaaggagaagcataacaaaaacgctgaccaatgaaaagtggccagcgttttctcattaaatgatgtcatcaccgatgcgggcaatttgttgatcgatttcacgctcacgttcacgcaaagcatgtgatgcagtgtgaatgatactcgttgaacgagacaccttgttataaaggacatccgtcgcaaacaacgagtactctgacattgcctttgacgcaactacttgggcaatccacaagtggtcttcggccaattcaagagtttcatcgaagcggaccttactatccaacaaatctgctgaacgataaatcttgttccaaaccatccctgaaatgacgtgaccacggtgcgtcacgccttcaaacataccagcgcgatcaatctttcggaacttaacctcgtgagccttcttcggcgcaccactagcaccccagctaaagccgacgctcgcgatgctgacatcaggatttccttccaaggcaccgaccaacgtttcgacaaatgatggcgccaattggtcatccccatccacaaagataaagtacttaccacgaatttggttgagtgcttgattacgaacagctgcgacacccttacgcttattattcttaataacacgcatgcggtcatcgcgagctgcccagtggttaatttctgacatcgtgtcatctgatgacgcatcatccaaaatcacaatatccatgttcttataagtttgcttatttacggtttttaggctgtggccaatgtatccctcaagattgtgactcaacacagcaaccgtcacgagtggttccttatacattgtattttcctcttttgtttaatttcatgaccactataaactaaaatccgcacgaccggtggaaaaaggtcgtgcggattttctgatgtgcgtttaattgtagttggtcaaattagaaagtcaaaacaaccttaccgcgaacggcttgtgactcaacaatcttgtgaccttccttcaagttttccaagttaaatggctttacttcggcaacagcaaccttgtagtcaccgtttcccaagtgctccatcaacttcgtcaaaacttcagtcgttgattgcatcacgtagtagtcacccttgatgttcttggcatcgcgagcagccttaacgtcgtcacccaaaggaacagtagacacaatgcgtccgccttccttcaaaacttgcattgaacccaaagcattgttaccaccgatgatttcaacaacagtatcaactgatgactctgggattacgtcagtaaacttttgcgtcgtgaagtcgatcgtctcgatgtctgcgttcaactcgtgtaggtagtcgatgtcagtaggcaatgacgtcgtgtagatctttgatgcgccacggtacaaagcagtttgcaaagcagcgtaaccaacagcaccggcaccaccgtggatcaagattgactcaccttcttgcaagttcaatgcatcaacaacggcttggtaaccagtttgaccacccaaggccaaagcggctgcatcttcaaatgaaactgaatctggcaagtgaccagcagtgtcagcatcaacaacagcgtactctgcgtatccgtgctcgtgtggtacagcaacaacgcgctcaccaaccttgaactcagttacgtcagcggcaactgcttcaacaacaccggcaatcgttgatccaccgatcatgttttccttagcaggcacaccaaaggcaccggcacggaacttaacatcgtatgggtccattgcgatagcagcttgcttgatcaagatgctacccttcgtcaaaactggtacttctacttcagcttcgtggaagacatcaacgtctccaaattcgtcaaatacaacggccttcatcgtagtcatatcctaagtccttctttcgcttcaaaaaatctcaaataaaaatctatcaatatttatgcaacttattttacacttacgaaaagtaaatgcaacagaaaatgccaactttgtgaaatttagtggtctagactgtatactctaagtatgacagaaaagcggaggaaagtgttgtgggaggctttggcgtacctatcaaagacgcaattattgcgtttccaatcatactaattgttttattcgtaccatttttatttttgcaatatcgtcgcttcggatccgtgactttttggcacacggtgatgacgtttagttttgtattttactttactacggcctatttcatggttattttgccgttaccaacggaagcaaccttggagcatttgcaggcgattcgtgcacagacgatgaacctggatccgctccaagttgtccgcaccttctttaacgacaacccctacttccacggtggcgggttgaaggccggcttgttggacccatcatttacgcaggcagcctttaacgtgttgctaaccgtaccattcggtatgtatttgcacttttactttaagcgtggtttcttcacaacattaattttaacgatgatgctaacggcgttttacgaaacgacacaatataccgcgttgtttcacatctactggcgcccataccgcttgttcgacgttgacgacctcatcttgaacaccatgggtggcgttatcggttggatttccgctccattacttgggttgattttcccatcccgcgatcgcatggatgaacgcgcacgcagccttggccaccgtgtcacgctggttcgtcgtctactatcattcggggtggatttcgttatcgcatcatttatcggattcattctgaatcaaattgtgccaaatcaaacagcaactgaccttgtgtcatacctcattgtttggggtattatcccattcttaattggcgcaacacctggtcaattagtcgtccgtacccgttatgacgtggctaaatcacagcgttggcgcattttccttcgaaacgctatgatggttggctttacgatttacttcttcccattctggttgcaactaattggttctaccggaacggtatcagctgaattgttgaaccgaacatacacgtttattctattgtttgcggccccagccgttgtgttggtcctagattggttaatcacaatcttccgtccgcaacacaagctactatatgaaaagattagtggcgttggttcagaggctatcgttaagcaaacgacgatggctgacgcgccaattatgcaagaacaaccacaaacacccgctacgcctgatgttgctcctgagcaaccaaccacgcgcagcgagcgtcatcaatagtcaaaagggcactgcaaaaatatgcagtgccctttacttatttatatagtagttagttcattagcgaacaaccgcaacggcccacttcttcttaccgcgctttacgatgacgtacttaccatcgtactttgcagctgggttgataaccgcttcttcgtcagtaatttgctcaccgttgatacggatagccccgtccttaacagacttacgtgcggccgtctttgacttttccaatccagctgcaacaaccaagtccaacaagccgatttcagtgttgtcgatttcgaacgttggcacgtttccagccaagattgcgacttcatcagtcgtcaattctgacacgtcagcgtttccgaacaagaccttcgtcatcgtctcagccgtcttaacagcatcagcaccgtgaacgaacgtcgtaacttcttgagccaaacgacgttgtgcgttacgagcagctgcgttttcttgcaagtcagcaactaggccagcaatttcgtcttgtgacaagaacgtgaagtacttcaacatcttctcgacgtctgaatcagccgtgttcaaccagaattggtagaattcgaatggcgtcgtcttttcagggtcaagccaaacagctcccccttcagtcttaccaaacttcgtaccatcagccttcaacaacaaaggcaccgttaaaccaaaggctggtgcttcaccaccttcaagcttgtggatcaaatcaataccacccgtgatgtttccccattggtctgacccaccaacttgcaaacgcacgttttcgcgcttccacaactcgtggaagtcgattgattgcaagatttggtacgtgaactcagtaaatgagattcccgcttccaaacgtgatgcaacgacgtccttagccaacatcgtgttgattgagaacaacttaccgtactcacgcaacatgtctagcaatgacaactttcccaaccagtcaaagttgttaacaatcgtgaagccatcttcaccgaacaacttgaccatttgggcgcgaatcttttcaacgttagcggccacatcttcttgtgacaacaacttacgctctgacttcttacctgatggatcaccgattgaaccagtggcaccacccacaacgatcactggcttttgaccagccaattggaatcgcttcaaaatcataaatggaatcaagtgaccgatgtgcattgagtcaccagttgggtcgataccaacgtataccccaatttgctccttagccatttggtcacgcaaaccagcttcgtcagtagtttggttgatggcaccacgccattcaagttcttgcaaaatatcttctgccatgaatcctgtctcctttagattattacatctgattgattctttggttgggtacaaaaaagcgccccaaccagctataacactgattagggcgctgttaaacgcggtaccacctaatttgccacggtatgccgtgaccactcatcttcccagtaacgttggggcgacgcacatgaggtttatgcgggtgtaattcgagcttcggaattggttagttcacaacgaccactaactctctgactgtccaccaattatctactgaaaccgctcatgcgatattggtagtataacacgaaattataccgataaaaaggtacgattctagaacgcgccaccaccagatccaccgccgaatccacccgatgaaccgccagcaccccaactgccaccagtgtcagacccgctacttgcaacaccgaaggccgagacactcgatgggttgaacatcgtataggccacatagattggcacaaagtttgccatatcatctaccggttcgagctgggcttggcgcaaggcatccgcaactttgtcggccacaccaagtacaacagcgtaagccaagtaacgatcccataacatcacgtcaggtacttgcttcacctcgaattgaccaacatcccgcaacatgcgtccaaagccaaaccaggcttccgctattggccatccttcaactgtgtatatttgtctaattttcaccgccatcgcaaatgccaccacggcaatcagaacggatagaccaacactaaccccgataaaccatcctgcaatgtgcgctgaactcatcacccagacggcgccgttaattaccacgacagccactgcggcaacaatagtccaaacttgccattgcgttaattgcgacactgcatcatggtcaatcaaattgactggcttggcagctcgtcggacttgatcctcgaaacgatcaattttatcggtgtaacgttttgcaaaagcactctcaccgtcttgcatcgtctgcgtttgaatgctcttcccaatctcaacttgttcgccaaacaaaatcgttaataacgtctcttcaaaaacgttaaatgctgtcgtgcgatccagttgaatccgataatttgtcttacgccatttctttgtcggttcttccgaaacaatcaaaactcgcttcgctaacaaatccatcaaagtggcactaaacaacgttgaaactgctgcgccactatcacgtagctgccaaccaacaaccgctggcggtaaatcagatggcaattcataattatgtggcgtctcaataatatgcttattttgcacacggatacgacgccacagcgcaattaggcgaatcaataaaccaaacggtaaaatagcaagccacgtgacatagccttgcatcgctttatctcgttttgctgtcttttcagctcgttcagcaatggctcgttcttgatccagaatagccgctcgtcgattgcccgttcgttgggttgctgtcgataatgctgcttggtcaaacattgtatgcacttcaaccggctgatcagggttcacccgtgccttttcataagttagcgtccccgcttgtttatccaccacaaattttgttgcactcttcgaatgcgtccacgcctgcaaggtttggtaagtcattttcggtagctgaatcacaatttttgtgtgctgcaaatccgtttgccaattcgcaccgatgattttccaattaatttcaccaacatcttgataacgcttaacgacgttcgctagttggtatgtccacgtgacttgatacgtatggtcagccttcacaggataatgcacccgaaattgcgtgacatccccatcacgcttttgctccaggccgtatcggcttcccgcgctaaaactgccgaccgactgaccattaaccgttgccgttggcgatccaatcaacttaacatcttgatccgtttcctgactaacgtaaacaccgttcatgtcatcatcaaaatcgtaaatcaaatcgtagcgaatcatagctgaaccgtctgaattaacagttacgtgttcatacatttgtttaatctcatagtcgtcatcagccgatgccacttgtgtcccaacgagcatcgcgatgaccaccgctaaaagaagtttcagtatttttatcatcttatccccatttcaggttacatattccccgtcatctactctctttattttatgcctttcatttgccctaagcatctttaatatttaaaaagcagtgtgttgattatatttcgtcaacacactgcttaaagaattagttatctgtattaataatatcagccggttctggcttgcgtgaatcgcggtacaaattgaaggctgtgtacgctgccaacgctacgataaagtagcttagcaccgtgatattaatgccggtcaccaccgttgcggcaacaataacacccagcacaccaccgacgataattccggtaaagcctcgccactcaatacgacccgtgcgcacgaagccgatggccgacgtcatcataatcatcgccgcatccatcatcatcactgggaaagcaaccaatgggttaaccccaaccaatgagaagaaaatcaactccggcgtatagttacccaacccaatagtcatcaacacacccaaggtgaagttcacgaccaaaccaagcactagcaaccagccgtgcaaaccgtgaacggccattgaatcagcatgacctgggtttgcgatgagcttaatcagcatcgcgatggctgccaatgccaaaccaatcgacaacccacgctgcattttacgtaccggccaattagccgtgatacgtgttccaaatgcagctccggtgatggctgctaaggtcattggcaccaaagttgtgacttcaattttaactgctgacaggaagaacaatgcctcaacgaataccggaatggcgtgcgctgcgttcatcgttcctggtagcttacggtcgtcatccaaccacttcgttcctttgaacaaagccgtcgtcgttgcaaacgatccaatacccaatgtatcgccaaaatctgtgataaatccaatcaggaatcccgggacaaacttacggaatggattaatcttgtttcggcgcattgatacggtatacaaaatcgccataccgattaacgcaatgattaatatcgcctgcaaggcccgtaatactagttgttctgtcataataaatctcctgattaaaaaagtttgtccgagtacttagtttaccaaaaatcagtgaacccggcatcttttttgcatcagttccgattaatgggcttgcttatcgcgtggtaacatacggtcagagatactctgtaactcaccgactagaatgtcatagtcctgtgttttcccctgaatgtaactgacgataagaggcaccaaatccactcccaccttgggatccaatcctgttgttgccattactttattcaaacgataacgcaccgttttagggtgcacgtgcagttgcgccgccgtttccgtaatggcaccattattggcataaatccataaagtcagctgcgcctcttcatccaacctactaaagtacgcaacaatatttttgtctgccgactgcgtcttggcgatattaatcagataggcaaacttgttataccgcaatacccgattaatatcatcagtcagtaaattgatatataaggcttccttaacactagccgaaatatcaaagtgcgctgtgccaataccgatgctaaaagaatcggctaaagcgcttgtaaagctcgggacacactcgtccgtcatgatatagcagcgccgatatttatctaaatcaaacgctaaattatattccggcatggtcgctgtctcccctttaacaacaaccgccacatactgtttcgctaaatcaacaccatgaatattagcttctccgacaaactcgcgactgaccggcgtatcgtagtcagaaatatacagccattccgtcataaatttctgtagcatgctaatccccttttgttcattatgaaaactcttcttttaataagtatacgctttcacaaatgaaaaacagacggactcctttatacggaaaccgtctgtttcgttgggattacgcggtaattaccgtaccatccccattttcaagatatgctgcaatattatccaatgatgtaatgactgcattacgaccagtggcagtaacaaagctcattgctgcctcaacctttggcttcattgatccagctgggaattgaccttcatcaaccaacgcttgcatctcggcaaccgttgcttgcttgatatcttcctgagttggcttcgtaaagtctttcgtgacgtattgcacggccgttagaatgactaactcatcagcatcgaccaattcggccaacttagctgcggtaaagtccttatcaataaccgcttcaacacctgtaatgtcattgtcctttcgaacaactgggacaccaccaccgccggctgcaattagcgttaccccttcttgcgcaagcgttcgaatcgcgtccgcctccataatactgattggctttggagatggcacaacacgacggtagccgcgaccagcgtcctcaacgatagtccaatctgggtgctcatcacgaacagtctttgcttcttcggctgtgtagaatggtccaattggcttagttggttgctcaaaggcggcatcgtttgcatcgaccactgtacgggtcaaaacagttgcgaccttttgatctaacccgcgactaataatctcttcgttcaaagcatctgccaaccacaagccaatttcaccttgggtcatcgccccaacagtatccaatggcatggctgggttctttgctgagctgccatccaattgttgcaaaacgaggttaccaacttggggcccgtttccgtgcgtcaaaacaagttggacatcccccatttccaaaaagttaaccaaatacttggccgtttgttgtaaggctgtttgttgggcttctgcacttggatcatccgtcaaaatcgcatttccaccaagtgcaacaacaattcgctttgtcatattacatttctccaatctcttaaatctttaagctacccgtggctaaggcaacaactgctgctactgcgagcaacaagacaattcccatcatcacgtactctgacttggtcacttgcttgccgtcttccttgcgtgctcggtagtacaacacaaatcccaaaacataaagaatcgtgcacaaccacaagtactgcaaacctgagaagacaatcgcagcgacttcaaagacaactgtaatcaaacctggcaagataacggaccacttctttgacccgataccaagcttcagttcatacgctccaaccaatacgtagcagacaacgattgatgcggtacacaatgagtacgcaaagttgtacgcctgatcagtaaagagcaacgtgataaggaaaatttgaatcaaaatttgcgtcaacaacaatgagtgttgtggggcgcggtacttgtttaacgtaccgaaccactttggtagcaagcgttgttctgccatcaaagatgttgcttcaactggcaacatcgtccatgacaaccaagctcccaaaattgaaataatcaagccaacactgatgaacgcaccacccaaacgacctgtcatgctttcaaacaggtacagtagcgctgggtgttgcatcccacgcaattgttctagtgacaaataaccataaggtaaaatcgaaacaaccatgtagataatcagcaatgacaccaagccgataatcgtggcctttcctgcatcggacttcttcttggcacgtgacgccatcatcgtagcgccttcaattccaacgaagacccacatcatggccataacacaacccttcacttgcgcaaagatacccgcacccgttgcgcttgaaaagacaagttgtccttgaacattagtggtcatgttttgccagaagtgtgccgtgaagacccccgccttcatacttaagaaagcaatgacaacaaaggcgaagatcggtaccaacttagtcaccgtcacaattgtattgatggctgcagccgactcaataccgtgtgtgacaagtaacgttagtgcccatgacacaattgaggcgacaataatggcgctgacgctgtttccagatttaagtggtggaaagaagtaacctaacgctgacatcagcatcgttgcgaaggcaacgttacctagccaagctgacaaccagtatccccagccagaaataaatccagcaaaatcaccaaacccggcacgcgcatagtcagaaacaccagttagttcaggcttcgtcagcaccaaatgattaagactcaatgccaacatcaagataccaaatcccgtaattacccaagcaagaatggccgctccaggtgttgcaccctgggccaaagtcgctggcaaatcaaagattccagcaccgattgcagaactaacgactagcgctactaaggcaggtaaagcaattcctttatccttagtatctgccataattacttaccggcttcttcaagcgcaggtacatctggaatgaacaagttacccaacgttgcagccatgatggccttgattgagtgcttgcggttttcagcctcgtcccagtgacgtgcgtacttgctacggaatacttcatcagtaacttccatttcagtgataccgtattgttccttgacgtcttcaccgtacttagtgttcgtgtcgtggaaggctggcaagcagtgcatgaagatcaattcatcatcaggcgtaccagtcttgcgcatcatgtccatgttgacttggtaaggcgtcaacaacttaacacgcgtctcccaatcagactcacccattgatacccaaacgtcggtgtagatgacgttagcacccttaacaccttcgtcgatatcagcggtaacctttagctcggcaccagtcttagcagcaaatccatttgccaagtcaacaacttcttgcgttgggtgcaactcttcaggtgcaacaatgcggatgttaacacccaacattgcaccggtaaccaacaatgagttcgccatgttgttacgaccgtcaccaacaaaggccaacgtcaaaccgcgcaagtggccaaagttttccttgattgtcataaagtcagcgatcatttgtgttgggtgccattggtcagtcaaaccgttccaaactggcacacctgagtacttagccaatccttcaacatcagattgcttgaagccacggaactcaatggcatcaaacatacgtcctaggacaatcgcagtgtcttcaacagactccttcttacccaattggatgtcgtttgaaccaaggtattctgggtgagcacctagttcgatagcagccgtggtgaaggctgaacgggtacgcgttgatgtcttttcaaacaacaaagcaatgttcttaccttccaagtaacggtgtggaatgtgattgtgttgcaactccttcaagtgcaaaccgaaatcaaccaaatattgaatttctgctgaggtaaaatccttttcagccaaaagtgaacggccttggaatactgagttaattgccatgattcttctttttctcctttatttgtctgttttacaaatcttcacgccagattggttgagacatgcaacgtggaccaccacgaccgcgtgacaactcacttgaaatgacttcgtgaaccaaaatgccgtggcgacgcaacaattcgttacttacatagttacggttgtaggtcacaacttctcctggtgcgatggtcaatgtgtttgaaccatcgttccattgctcacgaggtgcgacaatcgcatcaccgcttccagtctcaatcaagtccaactcagaaagtcccaacacttccttcaacgttgcaccaaggtcagtgcggtgagccaactttaccgtgccatctgggcctggcgtcatgataaagatgttcatcttaccgccctcatccatgattcctgggaagaccgtaaattgatccttattaaccatcgtaaagaccgtatcaaggtgcatcatcgcgtggttgtgtggaatttcaacggcaacgacagtatcaaagtgactgtctgggttagcgaacaattccttagccaacgcttcgattgactttgaagacgtacgttgtgaaacaccaatagcaagtacgtggtcgttaagcacaagtgcgtctccaccttcaatacgcgtgttgtggttgcggtcgcgccagatatcaacgtgaccagcaaagcgtgggtggtgcgtcatcacgaattccgtgaacaatgactctggttgacgagccttaaacgtcatgtggttaatggtcataccatttccaattgatgcttgtgggtcacgtgtgaagtaggcgtttggcaatggatccaacaagaatggatttgccgcatcacgaccagccaaatcgtgtagtgaatcattttcaaaatcaaattcattacgacgaaccccggcatacaacttggtaaccaagtcgcgcgtgttaaacgtcttcaagtaatcgttcagtgcatcgtgagtcgtaccgatgccgtaaccagcttcatccaagtattgttggacgaaagcttcgcgaaccttttcatcagtgtccaaagcttcaacagctaggtcatcgatataaagggtttcaacaccgttctcacgcaaagtattggcaaagaagtcgtgttcttgttgggcgatctccaagaatggaatgtcgtcaaacaacaaacgttccattgtgtctggtgtgatgttttcaacttcagcaccaggtcgcttaagcaacacggacttcaacttaccaatctctgagttaacattaatcgcaggattgttcatggttcccctccttatgaactttaacaaacgcttatgtaagcgcttcctttgctacgagttttattatgtcactcagtaaagcgttccaaaacggcccaatggccaaaggtttttatctgtttagataatgacacccaacgtttttaggtataaaaaaagacccacatcactgtggatctttagtggttctctattacaaatctgaaactgtgaaccgttcgcggacgtgctttggtgtttcgatttcatccaaaatacccaccgccatattacctgccgtcacgtgtgacttaccatcttcagccaacaacaagtcatccttggctgtacggtgagctgtggctgggcctggcacgaagttttgctgtggtgaaacgcctgtccagaagacatctggtgttgcacgcaaaatttctagttcaagcacgccataacgtggctcgtcaatccaggcttcgttacctggcagttctttcaagaagtcgaacaaacgtgtaccgtttgcttggacaagtgacgcggcacctagaatgaaaatgatgcgcgtttgcaaacgacggaactcgtgcaacaaatgcgtcaatgcatccaaattcaagtaagcatccttgtggttggcaaatgcgttaaccaccacatcgaattcctcgaacacatcagcgtgcatctcgaacaagtcgcctaccaaaattgtcgcatctgaccctagtttttcacgtgccttatcagcatctcggacaatcgctgtgacagcatgtccgcgctttgttgcttcttcaaaaactgcttgaccggccattccggttgccccaattactgcaatcttcataatcattacactcccgcgcttatttttcgttaattacattgtaccaaagcgacttaatcatttgcgcgaataatttgacgaacttggttagccagcacctttagtttcgtgccatccgactttgtgatgatataactaccatcatcttgcttaacaatcgccttaactgtctcagcgttcttagccacagtttgtgtaccaggcataatatagacatcgccattcgtgatatcgatttcaacgacacgattatccacgctggttgatgattttttagacgcttgtttagatgatgctggctcattttgcacaaacgcactgcgtgccgcccaaaagacaccgaacaacatcaagaacagcatgaagagggctgcaatgcgtttcacccacttacccgctgtcgatttcttcttctttgccatgctgatatacctctcccatttaactcttaaataaaagataccataaaaagcggccaaactcgtgttaccgagtttggccgctttcattacgttattcaagctgtcgttgtttgatcagtttagtcctcttcatccttcttacgacgctttgctgcaagcaacaaaagtgttgatgagaacaagaagattcccaaagccatcaaacgccaatcatccttgtaaccagtgttaggcaacataccaattcgacctggttcgttcgcataagccaatgagtaaaccgttggcttttgtgcaggaaccgcagctgttggcgtagccatttctgtcctcgtctcagtgacggtattaacaactgatgccgatgttggttgttgtgctggcacaacaacgttacgagctccggcttcagcttcagcaactgctgcttgcaaggccttaattgcggcctcgatatcagcagtcaaattgcttgaactatccttcgctgctgcttccaagattgcttgcaaacgatccaatgccttttgtacggcagggtcgccagcaacagacgaattcttggcagccgtaatcgccttatcggctgcttggtttgcatcagttcgctttgccttagcgtcatcaagcgccgtctgcaacgcctttgtagctgccgtaatttgatcggccgatgcatttggatcgtccagtaccttcttcaaagccgtaatcgcatttgcgacttccgcttcgtgtgaaaccggtgctgtcttaccaagcaaatcattggctgcattacgagccgcttcaatagtgttgttagccgtcgctacggcagcctccaaagcctttgtggctgcttcaatatcggccgtcaaagcatcagcattatcgccagccgcgcggttcatgatatcttgcaacttctgcaaagcttcctgaactgctggtacttgaccagccgctgacggcttcacaatatcaatcaatgactttgctgtatcgttggcttgcgtacgcgcagcaccaactggttgcaacgcatcacgcaaggctgctgttgcgttttcaatatccgccgttgttgatgttggatcatccaacaacttttgcaacgcatccttcgccgtagcaacattggtctcgtgtgaaactggtgccgtcttacccatcaaatcgttggcagcatcgcgtgccgcttcacgactggtattagcgtttgtgatggcatcttgtaatgccttcgtagctgcttcaatatccttggtcaagttaccatcctggtcagctgcggcttgcttttgaatttcatccaaagcatccaaggctgcttgcacagttggctccttagccaagtcagttgggacagccgctgcggctgcgtccgctgattcgttggccgcgtcacgcaaaggttgcgcaatggcaactgcatcgcgaagtgcttgtgtcgcatcagcaattgacttcgttgtcgacgttggatcatccagcaacttctgcaagttgctaattgcatccgctacggctggttcgtgtgaaaccggtgctgtctttgacaaggcgtcttgcgcatcatcacgtgctgcttgttgattattagctgcggttgtttgcgccgtttgcaacgcatcgatggctgcttggatatccttggtcaaggcagagtctgaatcagttgctgccgttgccataacatccttcaaattattaatggctgcttggacagaaggctcagctgattgatctgacccttgggcgtccgcaattgcttgtgtaccagccgtattggctgcatcacgatccgtcttatccgcaccaattgcagcattcaaattcttagtggctgcttgaatttcagccgtcgttgaatttggatctgtcaggatagcttcgattgaactaatcgcttgtgccgtacccaattcgtgtgaaaccgggttagccgaagcaatcgcaaccgcagcgtccttacgtgcttgctcttgggctgccttagcatcggcaaccgtctgcttcaaagcgttacgagcggcatcaaagcgttacgagcggcatcgatgtcagccgtcaatgcatcactgtcatcgttggcagcttgcttcatcacgtcttgcaacttcgcaatcgcatcttgcacagctggttcatcagcttgtggtgtgtttgatgcatccgtaatcgcgttttgtgcgttggtattagctgtcgtacgcgtaaccttgtcatcactcgtcgcattcatcaagttctgcgtagcattcttgatgtcttccgtcgttgctgccggatcatccaacaccttgttcaaagcagagatggcatcagccaccgccttttcatttgaaaccggcgctgttctagccaaggcatctgccgcgttatcacgcgcttcagcttgttccttagccgcttgtactacagccgtttgcaaggcatccaaagctgccgcgatatcggccgtcaacgcatctggtgtatctgtggccgcttcttcttgaatctcgttcaacgcatccaaggctgcttgtacagttggctcgttttgcgtgcttgatgcttcaaccttgctttcgtacttgttcgcctcatcgttaatcgcatcacgcttggcttgttcagcttggttagcttccgtcaacgccttcgttgccttctctatatcagccgttgatgatgccgggttgtccaacaacttctgcaaagcatcgtgagccttaagtactgtcgactcatttgaaactggcttagtagcctcgatagcatcagcagcagcatcgcgggcggccgtttgattttgcttagctgtttcttgcgcagctgccaaatcatcaatggccttttggatatcggccgtcaacgcagctggtgaatcggctgccgcaacggcttgcgcatcttgcaacttcttaattgctgcaatcacttctggctcagtggcttgatcagatgtcttcgctgcagttaccgcatcatcggcttgacggttcgtctcgtcacgacttgccttgtcgctcgccgttgcctcagtcaacgcatctgtagcttgcttaatctcttccgccgttgaatttgtatcattcaatacattttgcaagtttgcaatagcttctgatgtggttgcttcatttgaaaccggtgacgttgcttgcaaagcggcctccgcagcttgacgtgcatcagcttggctttcggcagcttgtgaaacggcatcttgcaagttcttgatggcttgttgaatatcagccgtcaaggcatctggcgtatcagtctgcgcttgatcaactaaatcttgcaattccttttcagctgcctgaacagctggttcgtccgcttgattagaaccattagcagcattaatggctgccttagcatcatcatcagtggcagtacgttgattaatcgccgtctcagttgccgaacgcaacgcctcggtcgcgtcactaatttgatcagccgttgaagctgggtcgtccaacaacttttgcaagtcatcaatcttactctgaacatccggttcgtagctaaccggtgacgtctcattcaacgccttggctgcatcagcccgggcggcttcttgcgcaccaccagctgctgccacagcatccttcaacgcttgcgtcgccttctcaatatcttccgtcaacgcaccagcatcacccgtcttagccttatcaatcaaatcttgcaaattcttcgttgcgtcgataactgattggtcattagcttgatgtgagctaccggccgttgcgatttcatcttgcgcggcttcatttgcggcgtcacgatcagccttcgcttgttcaacggcgtcattgtaatcgtttgtcgccttaacaatttcgtctggcgtactttctggattattcagaacatcttcaagcgcttgcttcttatcgatgacagacgcttcattttgaactggtgttgcatcttgtgcaagtgccgtctcacctgcatccttaacggcatcaatcaccgcttgtcgtgcatcttcaatggcttgcgttgtaccaacattgttagctgcatccttttgggcagcttccaaatcagcaaccgcttgcttaacggcgtcatcctttgaatcagttacctgactaacagttgtattcgcatcgtcgttctccttatcacgttctgactttgcgtccgcaactgcatcttgcaacgcttgcttagcttggtcaatggcttccgttgtggcatttggatcattcaaaacatcattcaatgccgactgtgcttcttgcacgcctggctcctgtgaaactggtgctgtatcaacagccttggcttctgcacgagcaaccgcattttcaagtgcatccgttgcatccttaacggcctgtgtcgtaccttgatcgttgtcagcatcattcatcgccttatccaacttcgccatagcatccgcaaccgcatcatccgttgctactgctgtggtatcaggtgaattcaacgcatcatcaccagccgtttcggcgtcttcacgatcacctattgcttggttaatcgcatcttgcaaagcctcttcagccgccgtttgttggtcagccgtcgtattaggatccttggccaaatcatccaaagccttttgtgcatccttaacagcttgctcttgtgaaactggtgccgtatcgatgagactcaacgtcaccgttttggtcgtcttgttaccagtcgcatcagtaaccgtaatcgtcacatcacgtggcttaccatcttcagctaccaaagcagcaactgtttcatagtccgtcttaatcgtgctgtcaccgtgttgttggttatcagtcgtactgaagccaacatcagccaagaaggttgcttcatcagctggcatgccggcctttgaagtcgtcaatgcggtcttggttgtcgtaaccgttggtgcctgcacatctcggtaaacatatcgaaccgtttggtccattgccgtgtcgtcgtcaaagttaacgttatcagccgtattatcaactaccttactttatccggcgatttgttcatccttcaccaaatcagcatcttggtaattaactgtttcgtttgtcacaccattcaatgtgtgaccgcttacgcctgtgtctgatgtcaacggacgaccaacttcatcgaagaacttaacatcaaccgtttgtggtaatggcgcgtaggtgataactgttgcctgtgaagactggtcggtatctgccgtcgcatcataaacaactgtgtaagttgccgtctgcttgtcctccgacaatgaccacgtcacgccatctgctgtcttaatattcgaaatttcgtatcccgtcggtgctgtgattgttcctgacatttgttgatcagtcttaccattcaatgtttcatcagcttgtgggaaggctggcgtattagttgcgccatctgcgtactgttgcgtgatagtcgcagtttggtcatcagcagcatacgtaatcacaaacttttgtacgtcagaatcttcaccagaaccgttattggtgttatcgaagtttgacgttgcagccaacgcttcggccatcgtgtcgtactttgaaccatcaggaccagttaccgtatatgtgtatcctggcgttgccaaatcagcatctgtgtacccagttggggcattaattgcatccccagtcagaccatcaatcgtctcactcttagccgtcactgacgttgcgccatctgggacgtcaatttcaaattgcgcttgttgctttgattgcgtcaacgtaatatcagtgttctgtggtgccgtatcggttccatcatttcccgtgtttgttgaattatcaaagtttccatccaatgaaaccctcttaccatccgttgcgatatcagccgtgatacctgaagctgttgtcactgcgccactagcaacgtagtaacctgccggtgccgtatacgtataaccatatgactcagccgtcttaccgttttgcgtatcagttaccgtggtcgtgccatctggcatgtgttgggtaaccgttgctttctggttcgttggtgccaacgtaatcaccaagttctgtggtgccttatcagatgcttcgttaccgttatcggtatcgtccatcgtcaatgtataggtcactgtatcgtgttggtcattggcatacgaaacgttatatgcagaaccatcaatcgcaacaatgtagtatccttctggcgcagtgattatgtcttcaagataatcacctgtcacaccagatagtgttcttggatcaggcgttgttggtgagccaattgtacctgagtagacaaaactaatttgaccagattgactggctgctgacaattgcaacgtaaagtcttgtgcagcactatctgaatcactggcgttatttgtgttgtcataggtaaatgtgaacgttgccgtacggccatccgccgcaacactggcgccagatggttgaccagatgctttaaagtagtatccttccggtgccgtgtacgttgatgtataaagcccgctcgtcacgccagctgccgcaattgacgacattggcgcaccgtcaaagctaatatttgctgattgataatccgccttataactcacaataaatgactgtgctgatgaatctgattgggcatccccattgctggtattatcataagccgcctcagctgcaaccgctgcagacaagtttgcatatgcttgtgatgtgccatcaggtcgtacaatcgacacattgtattggtaaccatcaaccgccaaatcggtatcggttgtcgcatatgagattggcgccttggttacaccgctagtcttttcaaccgccactccggctgaaattggtgaatcgctacttacgaacaatgcactctcttgatatgaaggcgttgggttcaagacaaacttcttaatacccgtatcgaccgcatcaaagctattgttgtccgcaaccgcttcatccaatgtcgcatagatctttggtgaaccagtttcatccatcacccaagtgccatcagcattttgtaccgtcacgttatacgtgtaaccatgcgtcatttccatagcatgcaacgactcatcggtcgtcttcaatccaagcgctgcaccggtatcaccggtcacttcttcaatcactcggcctgaatactcatcaccagtctcgccaataacaacttcagccgtttgcgtaatagctgaatactcaaccgtatacgtttgtggtgcagcgtcagaatctgtggcgttgttcgtgttgtcatacaaacctgtcataccagtcaaggccgaggccaacgtgttatacgtgttgccatttggcgtcttaacaatgtaacgatagccatcaagatccagcgctcaatcagttgtagcaaacgatacctgaccactcgtcacgccagcagcagagtcgagtgtgacaccactgctgatttgcgttgcgccaccaataaccaagttagctgattggtaatcagcgatatatgacaccgtaaatacttgtggcgctgcatctgatgaacctgtgttattcgtgttgtcataaaccgtgttagctgccatggctgctgacaaagttctgtaagtcgtcgcactatcagaacccatgtaaaccacataacgataaccactacgagctagcgttgcatcagtgtttgagaaggcaatcgcactaccggtcaagccagacgcactttcaattgtcttccccttttgaattggtgagttagtagccccgacaattgttgccgcttggctcattggggcatagctaaccatgaagttctgagtctctgcatctgaatcagtcgcattactcgtattatcaaacgtcgtatttgctgactgggcatcagccaaagttgcataccattcaccatccggtcccataacacggtacgtgtatcctgaaactgctagtgagtcatcaacatttttaaatggtatctgagtggctgtaccaccagaaagtgaagccaaccagctacctgcactcaccggtgaatccggcgttacacccaatgatgtccattgcatatcagctacatagttaactgtaaatgtttgcggcttactgtcggctgacccagtgttatctgtgttgtcataaacactatttgctgcaattgcttgcgacaacgtactgtatgatgtgccatccggaccactaaccgtatagtggtaaccctgcgtgtacaagtaactatccgtcaccgtaccaaacgcaatcgcaccactcgtcggaccagctgctgaatcaatcactgatccagcgctgattggtgattccaaaccaactgtaaccttagcttgttgtgaatccgccttatatgacacgcggaatacttgcgctgagccatcagacgttgccgtaccgttggcagtatcgtcaaatgtaccgttggcagccattgcagctgttaacgttgcatagcttgaaccattagccgcatagacaacgtacgtgtatccttgcaccgctagttgactatctgtctttgcaaatgaaacagcacccttcgtcacaccagcagcggaagccaatgatgaatttgcgctgattggtgaatcggcatccacaaccaatgcagctgattggtaagccgccttatacgacactgtaaagctttggatagctgaatcggtgctacctgtgttcgtcgtattatcaaagattgagtttgcagcaacggctgatgacaacgttgtgtacgtcttgccatcaggtcccgtgaccgtgtacgtgtatccagcaaccgccaaacttgcatcagaagttgcaaaactcaacgcccctgacgtcacgccagcagcggaatcaacctttgagttggccttaattggtgacgtaccagccacatttaccacggctgattgactagccgccttataactaaccttgaacatatcagggttagcatcagatgtgcctgatgccgtgttgttcgcgttgtagtacgagtgcgctgacaatgctgatgacaacgttgtgtacgccgttgtgtcactaccgtacttaacagtgtacgtgtaaccgctcttggctagttgtgaatccagcgttgcatatgacgaatcagacgcaaatgagatagctgatcctgttgaaccattagctgacaaggccattgaacccgcactaattggtgaatttgcgtccaccacaactgaggctgcttggctcattggtgcatatgaaatcacgaaacgttgggccgccgcatcggttgtacctgtgttatccgtgttatcgaatgtgctgttggctgccaaagcttgtgacagcgttgaataccaaaccgtgttgttcacgtcataaccgtatccaaccgtgtatgtgtaaccagacgttgccaaatcggcatctgtgaccccgaatgacatcgtttggctagtaacacccgtgatattggcaactgaagaccccgccttaactggtgaattctgttggacacgaatgtaagctgattgggcatcggctgtataatacacacggaaagtttgtgctgaagaatcagctgatgccgaaccattttccgtgttgtcatataagctgttggccttcaaagctgctgtcaatgttgcatacgaatcgccctttggaccgtatacaacatacgtgtaaccagtctttgcaagttgtgaatccgccgtgctaaatgccaatgatccactcgtcacacccgaagcagattcaactgctgagttggctgaaattggtgatgcactgtcgaccaccaaattagctgcttgatactgtggcttataaacgtatgtgataactgaatccaaatccgcatcgaacaaaccatcagcatccgaatttgcgtccggtcctaccaacgtgtaacccgcaattgtcattgccccatctggaatctttgagccgacataaccattggttgatcgagccgtgctaatcaccttaccggattgatcaacgtagttatacgtgaccttcgccgtcatcggtgcatagacaaccttgaaacgttgcacttgcgcgtcagtcgttgcattggctgcatttgacgtgttgtcatacttgttagccgccacggctgatgtcaaagtcgtatatgaattaatgacactaccggccgaattcaatacattaacgacatacgtgtaaccactcttggccaactgtgagtcggtcgtcttgaatgagatagccgagctagttgggccattagttgtttcgttaacagccgaatagctcaaaactgagttgcctgaattgtcggctgaatccgtaaacaatgaggcgtattgatttgtcttatacgtcaccacgaaggcttgtgatgatgtatctgaactacctgaatttgatgtactgtcataacgtgggtgcgctgccacggctgatgacaacgttgtgtacgccgttgagtctggcgcatccgtacccgtgtacttaaccgtgtacgtgtagcccgccttaaccaaacttgtatcgttggttgcgaagctaatcgtgccaccagttgtgccacttgctgacgtaagtgttgaaccggctgaaatcgggccatttggatcatacttaaccgctgctgcttggtaagcgccgacataactaaccgtgaatacctgggccgatgaatcagtcgttccagagttgtttgtggcgtcataaattgaatttgcagccacggctgatgacaatgttgcatacgttgagccatttggtcccttcaccacgtatgagaaaccagccgtcgtcaaattagcgtcggtatatggcaatgacaaagttgcgctggttgcacccaatgatgaagctaggaccgagccagccttcactggtgaatttgaatcaaccaccaagctcgttgtttgcgtagctggtgtgtaattaaccacaaagctttggtatgacgtatctgatgacgccaattgggaaccgtttgcgtccctgttgtttgtactatcgaaagagttcgcagcgattgctgaatccaacgttgaatacgtcacgttatccggtcctgttacggtgtatgtgtaaccagacttaggcaagttgctgtccttagtcgcaaagttaatcgcattgcccgttcgacctccagccgcatccttataagttgatgtaccagctacataagaaccgttggcatatgagaaattttgtgtgtacaagtatgcgccttggtaatcgggcatgtacttaaccgtccacgtttgtggtgtcgcgtctgactgcacaccagcactatttgatgtactatcccaaacgttagttcccgccgcataagcagatgacatcgttgaatagttgctaccatttggatcagtagcgtagtagctgtaccctgaacgaatcaatgagtcatccacaatactttgcgcaaccgacgcactgcctcccaatggattatcttgatcgatactccagtatgatgtgatgacacttgaatcactccacaaagctggcgtatctgtttgaatgattgactcttggcgaggcaatgcattgtacttaattgtaataacgttacccgttgacgattgtgacaccttcacactattcgttgctgaagctaccttataaccacgaatcgtgggtgccccgaatgtataatcagccgtacttgcatcggatgaaaggccagtaataccaacgacttcaccaacggccgtaacgaaggacgttgacggcttgattgtattaccgtttgcatcaacatacttaaccgtcgttgtacccgtagatagcacaccactaacgctatcgaacgaagcatactgatcgtttttgttttgtccgttgatggcattcaaaccaactgtcaacgccgtggccggtgctagtgtcactttcgcagcagccgtatctactgtccaacttgctgactcactattgcgggtcgatgttgtcttcattgtcgctttaattgatggcccaccatttggtccaccggtcgggttccaagtcagctcgtagtaaatcgtactattccagttcgacaagttatagccatctgtataggttgcagagttgctaaccccactgattttaccctgcgtggccattaacgtacccgaactattagttgttcgtaacgcaccaaacggaccttcagcagggtcatttttatccgaattcttgtggaaatcaatacccaacgcgtaggcattcttcatgccttcgataccaagtcctccaccacctttagctgtaaagtcatatgacgaggcaatcttattcgggtcagttggcgtcaacaccaatccagtccagtcggaataatcacgtgtcaaccaggtatccgcatctcgaacattagggtggagatatcccttaaccgtaaacggctgcgttgcatcaaattgacgcgtcaaatatgcgtatccagcagtactagcgccattggcaaccaattttgtgtaataggccccagccgggtctttataaagcgtacttccgtatgcacggtcggcgctccaagtcgatccattgtaagttccaagaccggtaacatcactgtagttccaagcattagatccattccaattgacgctacgactcacccctgcttgggtgtccgcatcagttacttgatcaattgttaatggtgaattaatcgttgcagcagatgccgcttcatccgaaacatccctggccaaacgcgctatttgtggcgctgaggaaaccacccccactgaaagggcagtcagtcctgcagccacccagaacttaccgcttttatacatcttctttcttgtttttgtttcacccatagtaaatacccatttaactttcctaaagtgagtgattgttacaaatttgtgacaatctacatttatagtgcaagtttaacaagttaattacgcttttgctgggttaacgatttgaacaaattttcactaaatagtttcttaaaaacctgttatataaacattgttagcgctttcttatttttagaaagggtttggttcccttttgtatatttatgatatagaaaactattgaggcacaaaaaaagagacctctctcactaaatgagtgcaggtctccttctgtttaagcggaccaccacgtaccgcttaaactccttcaccgtatcatgttaacaggcaccaccccgttaacaatccccatacatcgaggtgtccaagcctcgatgcgttttcctccgatcacatgtgggtccttcacctcccacacgcgaccattaccggacagcagggcatcgcaccctccgtaaacggcagtcctaggacatcactcctcgactaactgcatccccggcaacatttcaattatagcatatcgcgaccgactacttccgtcttaacggaggtagaaaatcgtgtcagcactcaagccagtcttaaccatcacttcaggcaaaagtggcgccttaatttcagtatcagccacaatttcaggtaattgttcagctgttaaaccagtcacggccagtgcttgcacatcccatgtcttgtgggcgacattgtagtagccagtacgggctgccaacgcttcgtcaacaatgttcaaaccgaacaaacggtatgtcacatattcaagcacgcccatgaagtgcgctgcgttggtgtaagcttcaggacgctcattcttcatccatagcgtcaacacaagcggttccgtcgccgtcattggcaagccagtcttacgttgcaattgaccaccgataccgttaatcatcaaggcatcaacgtacttcgctgcgcgattatcaccacctgagacaacgtcagtaagcggcgtaaagttttcgtccagtgcaaaccagccatttgcaatgcccgtcgcaaatcggacttcaacaatttcgtcgtactcacctggcaaatctgcacgcattgacgctaatgcatcaaccaacgtgttcacaatgttatcaggtgtcactggatcagttggaaatgccatcccctcgtaagggaaatgcatgaccttttgatttttattttcatcgatcaacgttgccacaacatcaattgcagccatatcaatcgttactgtatatttcattggcctacatcctctaaaagttaatacccaaaattatacactaaaacaaaagcacccgacagtttcctgtcgggtgcgctctcacaatctcatctcatgtagcacaagatgacaacactcaagaatctcacaacttaagcattggaaccacgcatatagtcattaaaaatggctattagttcctgccatgggtcctccccggtggcagacgcagcgccaaaggtcgatagggcgaccaacagcggcgattaaacttgtggtttttattttttatattttgtgggtctcacaaagtaattaagcggggaaagccgttttattacttagcagcgtccattgcgtgtccaccgaagccgttacgcaaagctgaaacaaccttaccagtaaacgtgtcttcttgtagtgaacggtaacgcatcatcaatgacaatgcgataactggtgctggaacttccaagtccaatgactcttcgatcgtccacttaccttcaccagatgagtgcatacgacctgagatagctgacaacttagggtccttagcaaattgctcttcggccaattccatcaaccatgaacgaacaactgaaccgtggttccacaacttagcaacggcttcgtagtcgtagtcgaattgtgaagcttccaaaacttcgaaaccttcggcgatggcttgcatcataccgtattcgattccgttgtggaccatcttcaagtagtgacctgatcccaaacgaccagtgtataggtaaccgtcttccaaggcgattgacttgaacaaaggctccaaaaccttccatgcttcagcgtcgtctccaccgatcatgaagtttccaccgttacgtgcacctgacataccgcctgaagtaccagcatcgaagaacttgataccagcagcagtcgtgcgcttgttttgctccaagttatccttgtagtttgagttaccaccgtcgatgatgatgtcgccttcgtccaacttctcgatcaaagtatcgatagttgagttcgtaggaacaccggctggaaccatgacccaaacaacctttggtgatggcaattgtgccaacatgtcatccatatcagtagctggtgataccaaatctgagtatgcgtcagcttccttaacaaagtctgcgttcaagtcaaaagcaacaacttcgtgaccgttatctgcagcattctttaccaagttcaagcccatcttaccaaggccgatcatagcgaacttcatttgagttacctctttttttcttgtgctttttttctacatgattattataatgcaaaagtttttcactttgcaacccttttgttgtaaaatgttttcatatccaaaatacggtacaatagaaaatagacagaacgttgttatgtcaacgtttcccgattctaaaaataaaaggagtttgacatggcacaatcaggttttgcgcgcattcgttcaatgcgtgatcaattatctggatcagatgaaaaaatcgctggctttatcctagccaacccagaagaaattcgttcattaacaatccaagggctcgctaatgcggtcggactttcaaccgcaacgatttcccgttttgttaagcgcgtcggcttcggttcattccgtgagttttcactcagcttagccgttgccacgcaatcagacgacacattctttggtgaaatcgacgaagaagacgatacgactgaaattgttcaaaaggtgttcagtggtgcaaccaacgcattggaaggtaccttatcaatgattaacagcgatgactgggcaacggctacgaagtggttggttgaagctcgtcgcgttggcctatttggtattggtggttcatcaatcgtcgccttgaatggttaccacaagttgttgcgtacacctttggatgtcgaacaacaccctgactacgatgtgcaactgatgcaagctgttcgcatgcgtgctactgacgtcgccatcgtggtatcacactcaggtcgtaaccacgacacgctaacaatcgcacgtcaactcaagaacaacggcgttaagattattgccattactgcttatcagcaatctgaattagcaaagacagctgatttagttttggccagtgctgctgaagaagttaacattcgaagcgaatcaatgtcatcattgattgctcaaatcacgattatggatagcttgttcactcttgtcggggtgcaacttggtgataaaacccaacaagtggttgatcatatccgtaccgccattgaaggtacgcgtgaatagtaaaaatcgtccagcgcgcatgcgttggacgatttttttagtgtaattgttcaattgttaatgtctgtaagtcggtcaaccaagtcttagttgcctcatcgacatcatcaggcataataaatggcgtcgttgaatataccgttccaacattagaccaattaatggcaccatcctgcaagaatgattgcttcgtgtcagcaacctgttgttctgtcacagctgccaaacgttctggcattgtggcaaacatcatcaaaaaccaattaatggccagttgccgggtaatcttttcagttacatcagtcacatcatcagtgactatgatgcgctcattcaacggcacagcaggaacttctttgttcaagaacttttgtgtacgtggccattccgttgccaacaaggcatagaattgccaaggtacctgattcgcaatttggccaagcgtcgtcacaaacaatttgtctattgaccacgttgtgccagttgcattatcaagcaaggtcatcaatacacgttgcatcgtttccttcatcaaaggagccaaacgtgtattttgcgttaggtgataacgaacaagtaaaaactcccccaccttctcaggcgtgattgcttttgcttctgttgccttagcttgttgcttaaaattcttcaaacgctttgctgaactaacgcctgcaaattgtccctgcttcaccatgtttttttaccacaaatcttccgtatagttttggtctggtgcacccatgatacgctcaccacgttgcaaagcgtcgatacgagccatatcagtcgtcgtcaattggaagtccaaagccaagttttgagccatacgtgctgggtttcctgacttaggaatcacggcaacgttgtgttggatttgccaacgcaaaataacttgcgcgatactgacaccgtaacgctcagcaatgcctgccaaaacaggatcttgcaaaacagcaccacggccaagtgggctccacgcttggtgctggatacctaactcttccaagtagccgtgtaggacatgttggttaaagtatgggtgcgtttcaatttggtcaactgccggcataaccgttgccttcgtcaacaaacgatccaagtggtgggcttcaaagtttgaaacaccaatagcacgtacgtagccttccttgtataggtgctcaagggcacgccatgtttcaaagaatggatcaaactttggccagtgtaccaagtacaagtccaagtggtccgtttgcaaagcagccgtcgtgttcttgaaggcttgcaacgtgttctcatagccttgttccttttgagcaaccttgctcgtcaagaaatagtcatcacgcttcaaaccagaacctgccaaaaagtccccaagttcgttttggttgccgtacatcgctgccgtatcaaacaaacggtaaccagcttgcacggccgcatccatcacttcaccatatgataatgcatcgttagctgcatccgtaccgaatccaaccattggcatttcaacgccattattaagtgtcacaaattccattgtgtcgtccccaatttccataagaatgcttacattttagcactcatttatgacgtttttgcgaaacatcgcgacaccagacaattaatcttaaaattaagccactcattagtcaatgaaagaggaaacgggagtcagcaatttgccaactcccgttcaccttatttcttattagcttttacaaaaatccatgacaccactaacacaacgataatcgcaccgataattgatggtatcaatgccatccctgctagtgatggaccccagtcacctaaaatcatttgtcctagccatgatccaactagtccagccacgatgttggcaatccatcccattgatgcgccacgacttgtaatagctccggcaattgcaccaataatagctcccacaatcaatgtccaaattaaatgcataattaaatccctcctatgtcctatagcttactttaactctatcaacaataaattacccgtacaacgacttggctgacagttcacgcttttgtgcaaagacttttgtacgttaccgttcatcatggtactatgggggcaggaggtggatactatgtttttaacaatttcagatgcagcaaaggctaagcttgctgctaagctaacaccaacaaccaaaatcgtcttggattttgatgacggcgttggaccgttttcagatgccgggatgtgtacactagacgtcgcttttaacgtggtcttgtgtgaggctaaggatttaactaacgattttgacacggtcatcgacagcgacttggggcctgtttacattaaggggtatacgaaggcacaaatggacagcgacatgcgtctagatgttgataagtatcttcgttatagcttgtcaggtccatcagggacgcttgattctaacgtcggattgcgtgacattcaaatggcatagcaaaaatgggtaccagaaatattctggtacccatttttaacgttcatttagttgtgcttgtagttgcttaatcttattgattaaggcgtcttgaatgattgctgcattttgatcagcaaccattggctgaggtgtcataacaaccgcttctgatgtttgttgctttagttgttggttctcaagggctagtcgatcaagttccgctgccatttcttgcaaagcaccttgtaagtccccgacttgcgcttcataaatttcagctccagtgcgccacttatcaacttcagcttcagaggcctttaaggctgcttctaactcaataattcgctcttcttcgttcatgacaactctcctttcgacttcacgattgtacaaaaaaaccatcctcaagcgaggatggttttaactatgccgactgggggattcgaaccctcgacctacggtttacgataccgttgctctaccaactgagctaagtcggcataactccgaatgtcgggctcgaaccgacgacaacacgattaacagtcgtgtgctctaccaactgagctaattcggaataataaatgcatcgcgacgtcctatcctcgcaggaagcgatcctccaactactttcggcgctattgagcttaacttctgtgttcggtatgggaacaggtgtgacctcaatgccatcatcacgacacgcgttatttctaacttacaagtcattattctacgtaagaatcaacatgttgtcaatacttttgtatgatgaataatgaggactctcgaaataaaaaaacaccttcgagcgaagatgcctttataacgagtgccgactgggggattcgaaccctcgacctacggtttacgataccgttgctctaccaactgagctaagtcggcataatgatgcctcttatttcagtccaaaacaccgttacccccctattaaaaatttttcaaaatcaaacttttctacaagaatacagtaatgtgtgtgcttttctttttgtgtagtaggggcgggggtatttaggcagtaacgaacaaggaggatgccgtggctgataagtacgataagtgctaagttaataatacacaggcacattggataaaaagataatgctattggatagattagccgcgttggtcccgttgagcgatgcacagtccaaagattacggcaatatacggacggattttgagggtacaataaaagccggcagcatggcttagatgctaaccggctaatagagctaaggcactcgtatttgattgtttttgttgctagtgggtgactaagtgggtgactgacgaacggtcaaacgctgaaactattgatataatacaggtttcaggctgtgtggtctgtttccagtatgcccagttgaataaatttgagaacgttgatacgtcggctttttgcttgacggatcaacgttttctttttgcagtcggaaattatagaccttgcgttttcggcgtgatttcagtaggatttaggttgtctttcaacttactttaagttagtttggtgatgaagggcgagacgcgtgcatttagagaaggggaaaataaatggcagacgttacgtataagattacgcatctcacggtgcagggagcaaacaaacagacaatgcgcctgttttatcgtgatattttggggctgattgaacaggaagttgcagagaacgaattttcatatgcatttacagctgacgaaatgccgtttttaactattgtatttggtggtaaggcgcctgctgaaaagcgtggtggcttatatcatttcgcgattctattaccagacactggtagcttagcaactttaattgatcgtttgattcggttgcagtacccaatgggagctggtgatcatgacgttagcgaggcattctatttgaatgatccagatggcaacggcattgaattgtatcacgaccggccaaaggaaaattggcgctgggataatggcattgtgacaatggggacggcgaatgtcgatgttcaggcattgcttgaacataaaaatgacacgtggaccggctttccagttgggtcgataattgggcacgtccattttgtgggtgatagcttaacaaagggggatgacttttttgttaagttgctgaatatggacaccacgtatgtgattacggacaacgcacatttctattcacacaatcattatcaccaccatcatgcatacaatacatggttaggaaatggtgttaaaatgcgtcaagaaaatgaaattggtctcgttgactggcaagttttggtggacgagacatattttaacgaactgacgcaacgtgcaggtcacaagttattggatgaatcaacattgctaattgatgatccgtttggaaacacattaattgtagaaaagttttaattatgcacaaagcgcctggaacgtatatcagttccaggcgcttttctttataggtaataattcagtaagctaccaacaccataagcaacaattgccgcgacgtacccgacagaaagtgtgcgtagaatttctgttcttactttctgctctgacaggttggccttcacccagcctagtaacgccaaagagacaccgacgatgacaaaggcgattggaaaggcgatggctttgtcgtgaatgagcgcatttgtaattaagtaggcgcctagtggaattaaaccaaagacgttaaacgaaatgaatgtcgcgataccggctgccaatgctttgcttttggattgattgttatccgatgttgctgacaggtaggcaccggcccccattgaaaagccatcggctaataagtttgagaatcccaaaatgatgataacgatgtttgagacgttaccaccgaccgatccagcaacgactgcgaacgtcgtgataatgccatctaagccaccatagacgatggctgaaacgtgttttttcatttattttctccagtttctctcagtggtgataaaaccaatatataagaaaaaagtgaccaattatcggtaatttcacatcggattaaaaatgtttcaaaaacgaaacaaataaaaaccaatctttaagtctcaattaactaatagttagtggaagattgtataatatttagtaagggaggagggcaaagagaatatgtttatacaaaatacatttagtgatagctcgctgactgttttgttggtttcgctactcgttttctacccgattttcggaagtattgtttggattgttggagcaattaaatatcgtagcatgattaaaaccaacacaccggttattccggaaagtatggttttgccaaaggtttcgattttggttgcggcccacaatgaagaactacaaattgataatacaatccgtcgtatgctttatgacttaaactacccaaattatgacttaatcattgcgtcggacgggtcgactgaccgaacaaatgaaattgtgttggaatggacgaaaaaagatccacgtgtccgcctagttgaaattcaggaaaatatgggtaaggcgcacgccattacacaagcggcgttttacagtgatgctgaattcttcctaggaattgatgcggacagtttcattattggggatggcctcaaagacatgatggcatatatgttggtggacacagacttttcaccagctaatcgtgttggtgccgttaccggtgcaccaacgccgatgaatcgttcgtcaatgttagctaagttgcagttggttgaatataactcaattatcgggctcatcaagcgtgcgcaatcaacgattggccgtttgtttaccgtttctggtgtggcggctttgtaccgccgtgatgcggttgttgatgctggttattgggatacgattatggccgctgaagatattgccatgtcatgggacatccaatcacgcggttggcgtatcgcttatagtccaagcacgttctcatatatggatgtgccaacgacagttaagcaattggttaatcaacgtatccgttgggccatcggttcgatggatgttgtaacagcttactggttgaagattttaacgcacccacgcaagacgttcccaatgattttcttgctgttggataacatcatttcaaccatttggtcactattttgggtggcttcaatgatcatcacattcttctatatttttgtgggtttctcatgggagaagctttacgtcttcacaacggtggcttcagctttgattattttccaatttatcttcggaatgttgcaattgaagttgtcacttaattacgggtcggaacttggggatgacaccaataagtacttcagatttgctggttggtacgtctgggcctattggattttgtcgccggttacgacagtgctggctattccgcgtttcatcaaccgtttgattgttggacgtagtggtacttggacatcacctgaacgaacgaatcttgacgggacggaggatgacaagtgatggatcagtggattgaaaaatttaatcagattttgacgatgaataagaccatcacccaaacgacgcaagaaatgcgtgaggtgttggatggccgcgttcatcgcattagccaagttgctaatcgattggctgatagtttggcactagtgattgccgttgttgcaatgtacttgtattgggggacaactctgatgcatgcgttgcttggaaaacaagataacatggtcatcatgctagcgattggtgtcatgggattcgggttgggtctttatctgattggtcgcccgattgcccgaatttattcgggacatgctcttgcgaagcatgctaatgaattgaatgcattgatcgatgatattaagttgtctaacgattacatcatgaaaattcaagcgatatacgcaaatgaaggattgccaatgcgtgcaattacttctgagaaaattattgatgcagtattaatgaacgttcgtgttggggcatttaagacgacgcaagatatcgtagatttcatgcagtcagttgatgatcgcgaagatttaattatcgatacaccggtttttcagttttataagattgtgaaccgctatcggtttaagccgaatgagacggctgatgttatccgtgatgacatcagccgcacggcaagggggagaatatggtagagaagaataactttgataagacgttggtttatgatgcttatctagacaaagatacaaaagagactggtttagaaaagaagcgtcgcacgtggttgcgtgtgcgtcaaacattgatgatggttttagcttggacgattacggcagttccatttttgattctgttgttccaagtttacttggcattggcaccaaattctaagtatcacttcttggcagtgagcggctactggccagtgctgattgctaatttggcaacggttattttgtcaatgcttgcgttgaccattggtgttagtttcattgttcgcaatcaaattaatgcgaacatgtttacgtacgataacgaagagcaagaatgcgtggcacacttgcacgacgtttgcgagaagcgcctcttcgtagaagaaacattccaagtgaatggtgatacgaaggcacaacatattgtggttaagccagcggataatctgtactacgatgaaatcgacaaggtttgggcatctgaagataaccaagccaaggaatacagtccaaatacaatttaatgcttgaaagcgcttgtgaataattgtttcacaagcgcttttttatcatgattttggaccgcaccatttacgggacacctagttttcacaaaacattcacaacctttgtcgtttgtgataaactgaataagaattaaaacttatattaggtatgtggaggaaaataatcatggcacaacaccaccaaaaggttgttcttgtcggagatggtgcagttggatcatcatacgcattcgctttgatgcaacaaggtatcgccgaggaattggttatcgttgacattatgaaggagcgcactgaaggtgacgcattggacttggaggacgctgctccttggacgttcaacaagaacgtttactcaggttcatacgacgatgctaaggacgctgatttggttgttattacggccggtgccccacaaaagccaggtgagacgcgtttggacttggttgacaagaacttgaagatcatcaagtcaatcgtgtcaccaatcgttgaatcaggatttaacggtatcttcttggttgctgctaacccagttgacatcttgacgatggccgtacaaaagttctctggtttcccaaagaaccgcgtattcggatcaggtacgtcattggacactgcgcgtttgcgtatggcattggctaagaagtttaacgtatctccagaagccgttgatgcttacatcttgggtgagcacggtgactcagagttcgctaactttgacgaagctatgatcggtggacgtccattgaaggtttgggctgcagaagcaggtatctcagacgaagatttggatcaaatcttgtacgagactgcccacaaggcatacgaaatcatcaaccgtaagggcgcaacgttctacggaatcggaacgtcattggctcgaatcacgcgtgcaatcttccgcgatgagaagatggtattgcctgttggtgcttggatggacgggcaatacggtttgaacgacatctacatcggaacgccagccgttatcggtgcaaacggtgttgaagctgttgttgaagcaacgttgtcagaagaagaagctgctaagatggctgcttcagctaagacgttgaaggaagtcgctgaaggtggcttcgcacgtttggaagcttaattaataatcattagaaatggtgaatccactggggttcaccattttttatatcctattgcaggaatttcacaaactataaaactttaaaatgcctattgttatcacactggggctggtttcttatgcttaatttcacaagaaagtttatgactactcatttctaaaaagaaagcgtacaatacaaattattaagtatgtaagcaattatttgaagaggtacaaaaacgcatgtctgagattaagaagtacggtgccgacctagttgtcgacagtttgaacaaccacggcgttgatttggtgtttggtattccaggtgccaagatcgaccgtttgtttgaaacgttggagcacccagctgaaggcgcagtttcaccaaagttggttgtgacgcgtcacgaacaaaacgctgcctttatggcccaaggttttgcccgtatcactggtaagactggtgttgttattgcaacgtcaggtcctggagtcggaaacttggcatcaggtttgatgacggccagcgctgaaaatgatcctgttttggccatcggtggtcaagtgccacgtaaggacttgtaccgtttgacgcaccaaagcacgccagcagctgctttgtttgagccaattacgaattactctgttgaaattcaagacccaaacaacatttcagaaatcttgtctaatgcaattgcacaagctaatggtccaaagccaggtgctgccttcgtttcattgccacaagacgttgatgatgcagtggttgatgctaaggctttgccacaagtagccccagctcgtatgggttcagctgcgattgatgacattgcttggttggctgagcaaattaagcaagcggaaatgcctgttttgttggttggtgcccgcgggtctgacgatgcaacgacagaagctttgcacgaattgttgacgcaaacgactttgccagttgttgagacgtaccaaggtgctggtgttatctcacgtgatttggaagagaagacgttctttggacgtatcggattcttccgtaaccaagtgggtgaccaattgttggcacaatcagatttggttgtcacggttggttatgatgccattgaatacgagccacgtaactggaacaaggatgccaacttgcgcatcgttgctttggacacggcggctgttcaaattgataacaactttacgccagagcgtcaattgattggtgccttggctgacacattgtcagttttgaaggacaaggtcgctggttacgagttgccagttgcctcacaaaacaagttggctgagttgaaggttgctttgcgcgccgcagacgagccaaagtacacgccagctgatgctggtttgaaccacccattgaacgttatcaagtcattgcaaaaccacatgacggatgaaatgacgttgacgtcagacattggatcacattacttgtggttgggtcgtcactttaagtcatacgtccctcgtcacttcttgatttcaaacggtatgcaaacgcttggtgttggattgccatgggctatggttgccgcaatggttcgtcctaacgctaaggctgtctctgtttctggtgacggtggcttcttcttctctggtgttgagttggctacggccgtacaaatgaacttgaacacggttcacattgtttggcaagataaccaccactacgacatggttaagttccaagaagagatgaagtacgatggtaagtcagctggtgttaagattgctgatattgatatcgtgaagtttgctgaagcagctggtgccaagggattgcgtgtagattcacctgatcaattggacgctgttttggatgaagcatttgcgactgaaggaccagttgttgttgaagtcccagttgactactcacacaactatgaattgatgtcacaattgattgaatcagaaatctaatcgtcgaaaaggtgtccgcttgggcaccttttttgcaaaaaaggaggatacaatggcagttgtttttcaacacagtacattagcagcgcttatggccggccttttgggcggaacaatgcgtgctggagatttgcttgaacacggtgacacgggaattgggacgttgcacggtgttgatggtgaggttatcatcgttgatggtgaagtttatcaagctgatcaaacggggaaggttaatcacatcacggatatggatgcaatgattccattcgcgacggtacacaacaataacgatgcaaccgaaaagattacgttgcaaaatgttgatatggaccacatcgacgtaattgatgagcgtaagttggcaaacaacttctcagcaattgtcttgcgtggggactttgagcacgtgaaggttcgtgttgcaccaaaggcatctgaaccattcccatcattgttggaattggcagaaaatcaaccagtgtttgaccgtgacaatgtgtctggaacgctggtcggttattactcacctgagttgtatcatggagttgttgcggccggctggcacgttcatttcttgagtgatgaccgcgagtttggtggtcacgttttggactttaatgcagccgaattgtcaggcgatttaacggttttcgctgattatgagttgcatttgccaattgataatcaagccttccgtgagcacgagcttgatatgaatggcctggatgacgcgattcacgcggctgaaggaaacaaaaaagattaatagaattatagacagatgcgactagcatctgtctttttctgttgtgtagcgtacaatagacgatgagtgaatttaatattgggagcaaagagagaaatcatgactgaatttatggatgctgttgttacaacagctaatgaaaatgaaccgttggctttgatgactattccagtgccggagatggcagagaaggatgtgctggtcaaagtggctgcagttgcagttaacccagttgatgctaagcaacgtgatgctgccgtagcaagcaacgcgacacgtgtgcttgggtttgacgcggttggtgaagttgttgccgttggtgaaaaggccacgaagtttaagacgggtgaccgaattttctatgccggacaattgggtcgtgttggctctaatgcgacgttccaagcggtcaatgaagatttggctgctctggcccctgaaaagatgactgatgcggaggcagcagcgctaccactgacgttcttaacggcatatgaattgcttgcggataagtttgggctagaggtggctgagaacgctgcctcgggcaaggctttgcttgtgattaacggtgctggtggtgttgggtcagtgatgattcaattagctaagtggatggggatgacagttattgcgtcagcttcacgtgaagaaacggttgcgtgggttaagtcacttggtgcggatcatgtcattagccaccgcgatgactacgttgccgagatgcacatgttaggctttgatacagtgccttatattgctattttgcacgcaccagagccacactttgaacaagcagctgagttaatcggtgcctttgggcatatcggcgcaattgttgaatcggttgagccaatgccagttggcttgattaagaacaaggccgcttcgttggattgggagttcatgttcgcaaaggctaactacaatgtcgacatggcgtctcaaggtgacgcgttggcactagcggcacaattggcagataagggatcattgcgttctacattgacggaaacgttgaacggcatgacggcagaaaatattctggctgctcaagaaaaagtttcggctggtgccgttaatggtaaactggcgattgtattttaaataacgtattgaaaggcttggtgagaaccaagcctttttctatgtgtaacaggcaaaatcatgatggaaattcagtcaaaacaagtcttttgaacgattttattcttcggtacaataaaggtgtaacaccatattattgtatgtaaattttagtttttttaacgaagcgtaaaaaactgtgtaagcctttagtggcgcgggttgaccgaattgttagggtgtaaattaaatgtaacaaaagtcataataagacaacaataaatgcattggattgcaacttctcgcgcgtagaataattagtatattaaagttaaagaaaacattataaagtctaaaaaagactacgattacttacttatagggagtactaacgaatgaatgcatctgtaaagaatacattactagttacggccggcgccgcagcaacgttggcaggatcagctgttgtcgcatcagctgactcaatcacagttaaggcgggggatacgttgtacgcgctagctgctgcgcacaacacgacggttgcagatttggtttcagctaacggcttgtcaaatgccaacatgatctttgttggtcaacaattgcaattgccaggttcaaacaacggggctaacaacaataacaacacggctgctaacccagcagcaactggtacatacacggttaaggccggtgattcattgtggggtattgctaacaaccacggtatgaatctttcagaattgctttcattgaacggcttgcaaatgaactctgttatccacccaggcgacacgttgaagttgtctggtgatgcagcaggtgataacaataaccaagcatcaaatgacaaccaagctgatgcacaagcgccagctactaatggcacttacacggttaaggccggtgactcattgtgggcaatcgcaaacaaccacggtatgtcattgactgacttgttgaacttgaacggtttgcaagcaacgtcaatgattcacccaggcgacattttgcgtgtatcaggtgacgcgtcatcagcaaacaatgacaacaattcatctgcatcacaaaacgacaacgcttcaaacaataacgactacacaaactcaggttcagtttcaacgacgaacaacacgtacccatacggacaatgcacgtggtacgctaagggtcaattggactgggttggtaactggtggggtaacgctgctgactggacaacgtcagctgttaacgccggtcactacgttgattcaacgccaagtgcaggatcagttatctggtttacgccaggtgttggtggcgtttcagtttacggtcacgttggtgtcgtagaatcagttaacgccgatggtacaatcacgatttctgaaggtaactacgccccaggaatgttgtaccaccaacgtacgatttcacctgcaggtcacttgttcatccacaagtaaacaggttaaagagctcttttggggctctttttttgtaaaacgagaggtaagttatgccatacgaaatttcagagacaaacgttaagcacttaaatgatatgggaaaggtggatgcagaattgcgatttacattgcctggcgaggcaacgttattccgtatcacgaattcattctttgcacaaaagatgcaaggtgcgcgcgtccaacaaaagttgatggaaatgattatggataagctacgtcaaaacttctggccggtagtcaaccgagttattgacgtaccttatcgaaatggtggtattaatctggcaactggttttgatgcaacggggttaaacatttatttctataatcacgtttatggtttgtctttgcctggtgatatcacgaagcaaatcgacattttcaatgaagtgccagctgaacaagcaattttaggtgatatgttggtttggggtggtaaaatgatgccaaccagtgtgggcatctatattggtggtggtcgttatattacggctgacttgatgacggggaaagttgtgcaacgcacgattgattacaactggcagcctgatatggtgttgtcagtgcgttaatgggggagacacaatggaatttacgaaggaaccgggtcgactatttcatgagactgatggggaattagatgctgaaatcttgttccctgaaattaatgatggccaaacgtggtcaattgatcacacgtatgtgaatccaagtttgcgtggtcagggtattgctggtcagatgttggcggaggtcgtttcgatggctgaagaagctggggtgacgttgcgaccggtttgttcatatgcccgcaaagcattctttatgaatcctgagtatcagaaaattcaggcaaaaggttaagacttatttgaaagcactcggtttttggtcggtgtgctttttaatttgagtcatttttcgatatacttgagatagttttaataaaatgggggcaaactatatggaacgtggatttgcagtagttaaaaaatatgctgatgccaatttgaatttgccgcagcgggcaacgcgccgtgcggctggttatgattttgaagcggcagaagattttgtattaccatcaatttggaagttaccatttgtcaaaattctggtgcatttggcgaccaagcaagaattgacggcgaacgactatgaggaagcaaatgctgttttgaagcccctcctagtgccaactggcattaaagcctatatgggcgaaaacgagtacttaatgattgcaaatcgctcatcgaacccattgaagcgtggcatgattctgccaaatggtgtgggtatcattgatgccgactatgttgataatgataaaaatgaaggtgaaatttttatccaaatgactaactggggattgcgcgatgttcacattaaaaagggcgagcgtatcggtcagggtatctttatgccattcctggtaacagataatgataagttgcaagagaaaaaagaacgcacgggaggttttggtagctccggcgttaattaaagaggtgtaggctatggctaaaacgaaaacacaatttgtatgttcgaattgtggttatgtatcacaacgctatatgggacgatgcgctaactgtggggcctggggcacgttcgttgaagaggttgtccaacctgaaaaggcagatcgcaaatcacgtgttaacttggctggtcaaattgcccgtgttgaacgtttgggtgaggtcagcatcgaagaaacgccacgtgttgatacatcaatcgatgaattcaaccgtgtcttgggtggtggtgtcgtacctggttcaatggtgctaatcggtggtgatcctggtattggaaagtcaacgttgctcctacaggtttcaagtcaattggcaaaccatggtggcacgattttgtatgtcgctggtgaggaaagtgcgtcacaaatcaagttacgagctgaacgtttgggtgtgaagggggatgctgatttcttcctatatcctgaaacggacatgacgcaaattcgtaaggctatcgatgaaacgaagccagattacgtcatcattgactcaattcaaacgatgcaacaacccgacgtgtcatcagcggttggatcggttgcccaaattcgtgaaacgacagctgagttgctacaaatcgccaagacaaatggcattaccatcttcatcgtcggtcacgtgaccaaggatggggccatcgctggtccgaagattttggagcacatggttgatacagtgttgtacttcgaaggtgataaccaacgtagcttccgtttgttgcgtgcggttaaaaaccgttttggttcaacgaatgagttgggtgtctttgaaatgaacgaaagcggcttggctgaagtaacgaatccatcaggtcttttcttagaagagcgcctagatgatgccagtggttcagcagttgtgattgcgatggaagggtcacgtccaatcttggttgaagtccaagctttggtaacaccaacggtctttggtaatgcacaacgcaccgcttcaggtattgaccgtaatcgaatttcattgttgatggcagttttggaaaagcgtgcgaacttgttgctacaaaatcaagatgcgtacgttcgagctgccggaggcgtaaaattagatgagccagccattgacttggcgattgccattgcgattgcatcaagctaccgtgacaaggggactcgtccaacggatgcctttgttggtgaaattggtttgactggtgagattcgtcgtgtgcccaatgtcgttgaccgtattttggaagctaagaaattaggtttcaagcgcgtatttgtaccaaagcatgcagttgatacgatgaaagagatttctggtattcaagttattggtgtcgcaacgttgacggatgcgctacgtttggcactggattagtgaggaaacttatgcgaaaacgaattatacaagcagcattctttgttgctggtggtggcttagcggtcacgttaatgccaattgtttggcggattatgaatcaacataatcaaatttggctaaacaatgccatcgtgaattttattattggtgccattattttttggttattgagtttggcactatggcgtccggttgatcaagggattcgtaagattgaagcatacttgaatcaacagtcgccagttgttttgttgattggttcagtatcaacgttgattggtttggcactggctgtcttggtaactgtcccactgcaacgcacaggtaatttctttttaagtgcagttattccagtttttgtgatgttgctatttggttatcttggtttccgtttaggcacaacgcgtattgatgaatggcgtacgttggtgccaaacttcaacaacatgacgaagcgcgttcgtccgcgtcgttcagcaaatcaaagtgatgtgttgtctgacgaagaaacgaactatcaccactacaagattttggatacgaacattttgattgatggtcgtattgctgatttggtgcaaacaggcttcatcgaaggaacactgttggtaccgaactttgtcttgtatgagttgcaatacattgccgatgcaggtgaatcaatcaagcgtgtccgtggtcgccgtggattggatattttgaacgaactacgtgaaacggacgcgattccactcgaaatgtgggaaggcgattacgaagacatcaaggaagttgatgaaaagctaatccgccttgcaaaggatgtgaatggtatcttggtgaccaacgattacaacctgaacaaggtcacaaagttccaaaacgtcgaagtcttgaacatcaacgagctggctggtgccttgcgtccacgtgtggctgttggtgaccgtttgacggtgacgttggttaagaatggaactgagcgccaacaagcggttggttacctagacgacggaacgatggtggttgctgaagaaggtcgcgaccatctgcaagaaaccgttgctgtggaagtgacatcagctttgcagaccgatgccggacgtatgatcttcggtattgtggtggattaagtaattaacattgaaacccatgaaaaaccgcggtatattagtaagcggtattataaacagaaaagaaggaatagacagaatggctgagactactgagaagaagattcgtgttcgatacgctccatctccaactgggcacctacacatcggaaacgcacgtacggcattgtttaactggttgtacgcacgtcaccacaagggtgaatttgttatccgtattgaggacactgaccaagcacgtaacattgcggacggtgagaagtcacagttggataatttggcatggttgggattggactgggacgaatctccagctaacccaggaaagtatggtccataccgtcaatcagaacgtttggacatctacaagccattgattcaagagttgttggatcgtggtttggcatacaagtcatacaagacatctgaagaattggaagcagagcgtgaggcacaaatcgctgctaagcaagccccacactacgtttacgaatacgaaggcatgaacgacgaacaaatcgccgctgcacaagctgaggcagaagctaagggcttgccagctgttgttcgtttccgtgtacctgaagacaagccatacgcatgggatgacatcgttaagggtcacgttgagattaactcaaacactatcggtggtgactgggttatccaaaaggctgacggtatgccaacgtacaactttgccgttgttgttgacgaccacatgatggaaatctcacacgttttgcgtggggatgaccacgtgtcaaacacgccaaagcaattgatgatttacgaagcctttggttgggaagccccaatcttcggtcacatgacgttgattatcaacgctgagacgggtaagaagttgtcaaagcgtgacgagtcaatcttgcaatttatcgagcaataccgtgagttgggatacttaccagaagcaatgttgaacttcatcgtattgttgggatggtctccagttggtgagaaggaaatcttcaacaagaaccaattggttaagatgtttgacgaaaaccgtttatcaaagtcaccagccaagttcgataacaagaagcttgaatggatcaacaaccaatggattaagacggctgaccaaaacatggtcttcgacaagatgatgcaacaacttgttaaggctgacttggttaacccagctgaattgacggctgaaaagatgcaatggttgcgttcagttatgaacgtttacatggacggtgtatcatacacgtcacaaattgtacctttggtaaagccagtattcttcgagatgcctgctgctgatgagattactgattcagctaaggaatggatggctgctgaaaacgtaccagcaatgttgaacttgttcatcgagaagttggaagcaatgccattgtttacggctgctgcaatcttgaatgcaatccgcgagattcaaaatgaaatggacgtcaaggcccgtgctttgtggaacccattgcgtattgcaacgacgcgtgaggagcaaggtccaaaccttggtgaattgctagaattgctaggacgcgagcaaacaatcgcaaacatccgcgagttcttgtaaaattaaacaacaaattaagtccagtgcctttgtggtgctggatttttttgttgttggtgtgtgtcgtcgctatcgcgccgagtgggtgtgggttcttagcgggtttgccgcttagagccacgaggaggtaaaggtgtacgctgaaacgcagtggactccgctccctacaggtcatggtccacttgggttagcgagccaaaagaaggggcaggtcactccgaccgtaagggaggacacacaccactagctcccacttaccacatattcaaaaataatgcacacaatcagcgttgtgagtgtgttaaaatatttgttagtaccattagctgtaacagctagtgaagacaagagggaataggtaaaagatggctaatccattacgtaaaattattgagagtgataaggggacaatgcgtcgcttgaaccgccttgcggatcaagttgaagcacatgccgatgagatggcagccctttctgatgaagaactacaagcaaagacgccttacttgcgtgacttgttgaagcaaggcaagacgttggatgatattttgccggaagcattcgcggttgtccgtgaaggtgcacgtcgtgtcttgggattgtacccattccgtgtgcaaatcatgggatctgccgttttgcacggtggaaacatcgccgaaatgcgtaccggtgaaggtaagacattgacggccacgatggcggtttatttgaacgcgttgccacaagaaggtgttcacgttgtcacggttaacgagtacttgtctgctcgtgacggtgaggaaatgggtgaattgtacaagtggcttggtttgacggttggtatcaacggttcagaaatgtcaccagatgagaagcgtgctgcgtacaacgcagatattacgtacacgactaactcagaaatcggatttgactacttgcgtgacaacatggttgcccgtaaggaagaccgtgtacaacgtccattgaacttcgcattggtcgacgaaactgactcaatcttgattgacgaagcgcgtacaccgttgattatttctggtgcaccagcacaagaaagcacacaattgtacatccgcgctgatcgtttcgttaagtcattgacgaaggaagaagactttacggttgacgaagaatcaaagacggttttgttgcaagacgaaggtattaagaaggctgagcgttacttcaaccttgaaaacttgtacgattcaggcaacacagctttgactcaccacatcgatcaatcattgcgtgccaactacacgatgttcaacaacaaggactacgttgtccgcgatggcgaagttgtgttggttgatgcgttctcaggacgtattcaagaaggtcgtcgtttctctgatggattgcaccaagccttggaagccaaggaacaagttcaaatccaagaagataaccgtgcgatggcttcaatcacgtaccaaaacttgttccgtcgttacaagaagttgtcaggtatgactggaacggccaagactgaagcggaagagttccgtgagatttacaacatggaaattgttgaaatcccaacgaaccgtccaattcaacgtgtcgacgaaccagatttgttgtaccctaacttgcgctcaaagttcttggccgtggttgaattggttaaggaattgcacgccaaggggcaaccaatcttgattggtacggttgccgttgagacttcagaattgttgtcacaattgttggaccgtgaaggtattccgcacaacgtgttgaacgccaagaaccacgccaaggaagctgaaatcgttgccaacgctggtcaacgtggtgccgttacgattgccactaacatggccggtcgtggaactgacatcaagcttggacctggtgtttctgatttgggtggcttggccgttatcggaactgagcgtcacgaatctcgtcgtatcgacaaccagttgcgtggacgtgctggtcgtcaaggtgacaagggatactcacaattcttcttgtcattggaagacgatttgatgattcgtttcggtggtgagcgtatcaagacgatgatggagcgcatgaacttggctgatgaagatgctgtgatcaagaaccgcttgattacgcgttctgttgagtcagcacaaaagcgtgtcgaaggtaacaactacgattcacgtaagaacgttttgcaatacgatgatgttatgtcgcaacaacgtaacacgttctatgcaaaccgtaaccaagttatcgatgaagacaagtcattgcgcaatgttattttgccaatggttgagcgtactatcggacgtgttgttgatcgtcatgctttgggtaagactgaagaatgggatttgcaatcaatcgttgacttcgccggggctgttttgattcctgaggattcaattacggtcgctgaccttgagggtaagagccaacaagaaatcaaggattacttgtatggtcgtgccaaggaagtctacgaagacaagcgttctgctttggttgatgatgagcaaatgctacaattcacacgcgtggttatcttgcgtgtggttgactcacaatggacggaccacatggacgccatgaaccaattgcgtgatgctatccaattgcgtggttacggtcaattgaacccattgattgagtatcaaaacgaaggtttccgtatgtttgaagaaatgattgctggtattgaatatgatgcaacgcgtctattcatgaagtcagaaatccgtcaaaacttgcgtgcataaatgttattggaggggaaagttagttgcgactggctttcctttttcgcattagagagttgaggttatagagaaaatggagctatcagaagcacgtcgctcattagctgagatgtcagaagagattacgaagtttggtgagtctctggacttggatgctttgaacgatgaaatcgcggccaacgaagacgaaatggttcacccagatttctggaatgacaatgttgcggcgcagaaggtgattgatgccaacaacatcttgaaaggtcgccgtgatgactacttgaacttgacggctggcgtagagaacgttgagacggcacttgaactattggctgaattgcctgatgaagacatgcaagctgagatggaagcggacttgcaaaagttgtcagacgacctagagagctaccgtttggcacaattgttgaacgagccatatgacaagaacaacgccatcttggaaattcacccaggctctggtggaaccgagtctgccgactggggtgccaacttgcaacgcatgtacacgcgttgggctgaacgccacggctttaaggtcgaaattatggattaccaccctggtgatgtcgctggtatcgactcagccacattgatgattacgggacacaatgcttatggttacctacgttcagagcgtggggtacaccgttttgtccgtatttcaccatttgattcagctggtcgtcgtcacacgtcattcgtatcaattgatgtcatgcctgaattggatgactcagttgaagttgatattaacccagctgacgttaaaatggacgtttaccgtgcctctggtgccggtggacagcacatcaacaagacgtcatctgctgtgcgtttgactcacattccaacaggtattgttgttgcctcacaacaacaacgttcacaattccaaaacaaggatacagcctatgctatgttgcgtgcgaagttgtatcaattggaaatggataagaaggaaaaggaacgtgcatcgatcgctggcgagcaattggaaaacggttggggatcacaaatccgctcatacgttttccaaccataccgcatggttaaggatcaccgtacgaactttgaatcaggtaacccacaaggtgtcatggatggtgatttggatccattcattaattcatacctacgttggaagttagctgaacaaaatccagactaaaaactaaaggaccgccaaacacgaggtttggcggtccttttctgtaggtatgacgaagtttggaatttactgaaataattgtggcgaatttacgagttgtttaaagtggattcatgaagtcggtggcaaagtgtcgttcgtcgtggtattattcgtacattgtttcgtatttaatcgagaatgttcgggggaaagactggattaagtaaacttagtactttaaaatgacttttttaaccatggggggataaaaatgggtatcgtaaatgcatcagaaatgattgcgcaagcacacgcacaaggatatgcggtagcgcacttcaacacgaataatttggaatggacacaagcaatcttgcgtgcggcggaaagccaaaaggcgccggtgattatcgcagcatcaatgggcgctattaagtacatgggcggcacgaagatggtagctgacatggtgcgtgatttagttgagagtatggcgattacggtgccggtagcgattcacttggatcacggtaatctagagatggcgtaccaagcgatgaatgatggtttcacatcagttatgtttgacgggtctgatttaccatttgaagaaaacctgcgcgaaaccaaggctttggtggctaaggctgctgaattgggtgttagtgtcgaggctgaagttgggtcaattggcggtgtcgaagatggtattgttgggctaggtgaaattgctgataagcaacaagttgttgaaatggctaacacgggtatcgacatgctagcagctggcatcggcaacattcacggggcttacccagaagactttgctggtctagatttgggggcgctaactgagtttgaagcagcgacgcgtcatgagatgccattcgtgttgcactgggcttctggtttgcctgaggacgaaatccaaacggcgatcacgcttggcgtggctaagattaacattaattcgcaattgcaatgggcgttccacaacgcattgcgtgaattcattgtgacagatcgcgatttggaaggcactaactacgatccacgtaagttgcttcgttcaggtgtcgacgctgcgcaacaagctgctgaagagatgattcaaatgcttgggtcagcgaataaggcacaagtaacactaacaaaggcataatgccgattgctgtgagggaaagatgaataagcctaaattgtttttggacatggacaatgtccttgttgatacgttacttattttgaatgcgattgatatggctggtgagacagtcgctaagccagatcagattccaggcatttttcgagatttgccaccggtaccaggggctattgacgcggtaaataagttgaacgactattatgagttatatattttgtcgacagcgccttggcaaaatgcgagcgcttggcaagataagttgatttggttgcaacatcatttcggtgatgatgagaagagtccattttataagcgcgtgattcttgcacatgataagagcctagcacgcacacatggtggcattttggttgatgatcgaccataccacggtgccagtggttgggatgatgcagagatggatagtcaatggattcaatacggttatgagcccaagatgacttggcaaaccggtttggttgagctattgattgaggccgcagaagtgtttaagaacggcgacagtattcgaaatgctgttgatacggtcatgaatgaacatcagattgctgtgcacggcgatacggagaagttcgttaaagctgcatgggaataacagacagagaaaaaggcttgggttagtgggaacccaagcctttttggctattaaagccacatgaagagaaaaaattagtatttaaagaaatacgcttgtaagagataacttacaagaatgagtatagcaaagatggttaggccggctgtgccagagttagcgatttttaaaccacaatttggtacggaaaaggccctgatttataaatcaggaccttcgtacaaaagaaatgatggttagtggcaataaccatatttgggaaagaaagttgtcgcacaaagcgacgacatactgcattcctacaaacctacctctaaactatatcattcgtgataaaagtgagtgtgccaattattaagcaaatcatccaacattttagaacggttattgttgggcgttcagtgctttaatagcagcttcaaataagtcccagtcacgtcgagtcggcggattactccattcaatatggaccgcatttttagcatcgtgaggtgtgatattagaaagcaaaatgtcagccttgtcagtgaattcattggtaacaatgatattatggttcgaagttgcgacaatccgagctttaaggctttcggtgtaagcataaccataagaaaaatccagtgcgaccactagtggcttttcaataatcgttctcggaattgtaatgaccaataggtacagcaaatcattgtagaaattctcttgattggtttcgaaatcggttagcttgtctgggaattgcgtcaggaacttcgcgaagaattccttcgaaacatctaaatactcagcaaaattatccatcaggtatgcactacattggtgtgtggtgacctcggaaaggggctgcgtatagccaagcaaacgtaacaggtaggtatctagtggcgttgtttctttcttgaagaacatgggagcgattgaccaatatgacaatgaaaaatgagttgcaaatgttttacccagcagttctttaatgggggcaatgtgattttgcaacgccacgtttttttgcaaagaaattggcagaatgttcatcgctaaaagaaagtttaggtatgagactgcctcccaagctagttcttcttcggaaaggtgaataccttccccttgaagcgttttgtctaaaatttcaatagcgatcgccacgttttctgaatcaactagtaatgtttctggcgagaagaacattcgggatccaacgttgtcttgattaaccagatgtccgttagcgattcggcgatagccaatatacgtgtagtaaattaaatttagctggtttgttggtgataactggaaatccaaacgctcagctaaattctttaatcatattggttgatgtctttaatgatgtatttgaaaacgggtactcaaagtcgcaaaatatgacggagtagtagtgataatagaactcacgtactgagatttcgtcaccagtcaaaactagacgctctgatagagccagatgatgtttccgaaagtaggctatcagacgtttgcggcgccgaaagaagttcgtacgtgacatcaaacttttgttcgagaagtcttcgacgttggtgaaatcttcttcgaaactgctttctagaatttgaacagtatctgaccgtctagaataaagatagcgtattgaagtgacgggtgaactatttgttacacgcacatacgtgattgtattgcgatcaaacgttaatgtaaaaagccaagataattcatccattgattcatgggctaacgtttgaacagcctttttaatgacaaattccgatgcacctagcaatcgtgacaattctgaaacggtggtgatgaccggtgctggcatattctctaacgtgacaattatgcgtaactgaatctgctcatattcatctaacaggtcaaaaatagccatggctagctccttgtgttatgcgtaaattcattctagacgtctgcattctttaatatctatcatttaaccaagaatttgtcggcagggagtaccaagctgtctgtttattccaacatgtaatggtacgttgccgaaaagatagtaaggataaagtgcacaaattgacgttccgacgttcgaaatcaagatttgcggtacttaacaatgtgttattgttcacattgttaataaaatcgaaagtgcctaaaactaggctttttcatttagtgtgttccgaatgcgaaacactaagtgtgaataaattgtgaataatatgttgctaaacttatgtaagtagatcaagataatgtatgttaattgattcacatattttaaataaggttatttattttttaggagatattattatgatttcatggctacgtaacagcaaggttgcaatgtgggtattgacgattgccagtgtttacttgggattccaatgggtaatggatggttttgagaaggttaccactaagggtgacttcgatgcttcaggcatgattaacatggcaattgctaagccagttatgacaccagcacaaacgaaggccttcccatggtacgactggttcttgaacctagcaacgaaccacggtcacgctactggtttcttctcattcgccgttgcatggggtgagttgtttgttggtttgggattgatctttggtacgttgactttggcagctgccttcttcggaatgatcatgaacttctcatacttgggtgccggtgttgtgtcagttaacccaacgttcatcttcatcgagatgttcatcttgatcggtggctacaactcatcacgtatcggtttggaccactgggtaacgccattcttgcgttcaaagttgccattcttgaacaacgatattgaagttcgctaagattaatattaaagattaaaaggattcggaaaatcactttccgaatcctttttttatgaacctagggctaatttggccgtgaattttaagttttggccacctgagacagcgtacaaccttttgggtactggtttgtggtataaacagagtaaacgcgttgtacatggggtgactaaaatggacagaaataagctagcaaaaaagatacgtaaacagatgaaccgtaacccaggtttatcgagtggggaaaagttttttatcgacaatttagcgttagcgaaagagacggataacctgataaaaaagtatcattatgcgataccggcggccgatcaaaatgcagttaaaaagacgcttgcaccaccgttggcggaagccctacaagcttctgaagatgatgtgaacgagctattggccgatattaccgtacgactgacactaaccgcgaaaccggatttggtttacgtttgggagaattcaaagaacgttgtttcgtcacggcgagtctatggcattgcgtatcaagttcgcgatgaaggggatgggctcgcattatttcgggatgtgcttacggaagccagggtgccacgaactagaatgaccgcgacacctcaagttaagtcagtcgagccacaaacgccaagtgaggatgtcacggcgttaaagagtcaaatcgatcgattagaaaaggcgaataaaacgttaaaagccaaaaacgttgcggctagcgaacgggtccaagagcttgagcgtgaattaaagcaagcgaatacggccacgacgcaagaaacagcggcgttatcagatcagcttgaaacggcgcaagcgacacaacaggcgacgcaacaaatttcccatcaacgtcaattggatttggaacatcaagcaaccaggatggaagaactgaaaaatcaggtcacggaatacgagaatttgcatcgcaatgaaagtggtcgtattgctgaacttgaggaagcgttgcatgaggcaaatgaatcgttggaacaactccaagttatgcagcataatacgacacagccaattcatacgaatacggattacaaggatactgtgattcgaacgttggcggtgcgcattagtggattggagcaacagcaacaagcgccggttcaagaaacaccagtaaccgcaccgcaaccggttcgcattattacgaaacaagctgagccagttgtgatgacaaaaactgtgccggtcacagattcagaggcgttatcacaattgattgcgcacttaacccgtgataatttggctgcctatcgcaaattgccgttgcttgttcaaacctacaatgagttaacaaatgatgatgttgctctgtggataccggtacaaggccgattctatgttgaagatgaagagcgctactttgttgataatcaggggcatctggtcggcatggatcaaattgacctgaatggccttgatgaagcgagtctgaatgcggaagagacatactcggcgcgtgttcgatcggatactcatgcagtacagttactgcgtagtctgggtagactgccagaaacaaaagccaccgaggacgaaaagactgcgacagatagtgaactggagcgacaactatttggtaaacgtgtgttgattgtgtcgtggtttggggcgagcgctaaaaacgctgcgaacaaaatcaacgaggttggtggtcaagccacgtggttagacggctcaaagtacacggaaagcaaagtgattgatgaaatccgagcaaaccgatatgatgttggcgttgtcctaatcaacgggtcgcatcaccatacggttaaggccgcgtgggaagcccaacgcgcgggtcagaatattcaagtaacgccaaacgcggggatgacgaaaattattcgtatcgcgatggatgcgttgtaagacaaaaaagcagtctgccaatactgtggcagactgctttttgattatttgcgaactaattctgtgtaggcgtcttcgtcaacaacgacgtcgatttcaccgatgtattcacgtgggtcatccttgacgaacgtgcgcttgaagacgaacaaaccatcttggtcagaagcttcttcaataccacccatatcatacaatgacacgcctgaatccatggcccattgaatcatggccgtttggacggcatatggggcgtagtagatgttaccgtcaaatgaaccggcgtacatgtaccaaatcttgtcaccgtacttaaagcccataccagttgaaagcaattcgccttcacgttcagcaatatagatacgcatgatatcatcatccgcaaacgcttcacgcatacgctcgaagtattccttaggacggtgtgagatgccgtgacgttgtgccatgccggcatatgtctcgaagaaggcatcaacggctgcttcgtcgttagcccaacgaacggttacaccgtcacggacgggacgcttcaactttgactttgtctttgaagggtacaagtccagcgtttccttggcatctggcttagcagtcaaatcgatgaccatgttcaaacggggttgaatggtagcgtgcatcccctggtcggccacgttacggttacgcgtttcgtagccacgggcacgcaaagcatcgttaaattcatctgagtaagggacctcaggatccatacgaatgacgtacacatcgtcgtcggccacagcaagcttggccacagcaactaacttatccaacaaatcaaggtccgtaacgtccattacaggcccctttgaggcgtaagcgaacttcttaccggttggcgtttgcgtcaacaaaagcgaaatagcggcaataatgttgccatcagcgtcttcaatatacgcgtggcgaggctcccaattattcttaacgtgtgcccagcccaagtcttgtgtcacttggccgaactttgagttgcggacaaacgtcgtaaaacgttcaacggcagctgcatcattcatatccaaaactggcattgtttttccttctttctaactgaaaaacagtctcattcaatctcaataaattataacataggcaagtttaccagtttcagagtataatgactcttatggaaactattacatcagtacaaaatggccgtgttaagtcatggcaaaagttgcaaacgaagaagggtcgccaagcaagtaagacttacttgcttgatggctggcatttggtccaagaggccattcaacacgatggtaagttgcacgcaattatggcaacaccagaacaattggcagaacaccaagatgacttgccacttggggtacctgtattcgaaattacggccgatattgctaagaagctatcagacttggtaacgccacaaggtatctttgcggaagtctcattgccaacggcaactcgtgaaccacaatttattcacgatggcgcttggttgttcttggatgcgattcaagacccaggtaacgttggaacaatgattcgtacggcggatgcagctggctttgccggcgttgtgtttggggatggatcagttgatccatattcaccaaaggcattgcgcgctatgcaaggctcacaattccacatgacattgacgactggaaacttgcaagagtggacagctgcgtttacgcaaaatgacatgaacgtttatggcacccaattggatccagaagccgctgacttgtttacgattccagcgcaaacccaatttgcgttgattatgggtaacgagggtcaaggcatgaatcatgaattggctaagatgacaactaagaatctttacattccaatttctggccaagctgaatcactaaacgttggtgtggcagccggtattgcaatgtttgcgttgaaggcacgctaaagcctagtttgataaggtactgttaatcatgcaaagagggggcttttatatgcaagattggcaacgcgacaccgcgtattataatatcgtgaaagatttgttagcccatccccaagtgcaagagttggcgaattacacccaacaccaccactcggatcggttaacgcattcaattgcggtttcatatgtgagctacaagtgggcattacgtcttggcttgaatgcaactgcggtcgcacgagctggtattttgcacgatctcttcttttatgattggcgtaccacgaagttcgagctaggaacgcatgcgtttattcatccccgtgtttcactacgaaacgctgagaagattacgcagttatcaccgatggaaaaggatattatcctgaagcacatgtggggtgcgacagctgcgctaccacactatcgtgaaagttttttgctggatttagttgatgattatatggcggttgctgagtttttctcgccagcatcagctcgagtcaaaagactattccacgcacactaaaaaacgactgttctgcatttttgcggaacagtcgtttttgttaagcacaacaaatgtcagtgcagcctttacgttcacactgaatcgtgcgaacggcttgcttaaacaattcgatgtcactgtaagttggcggattgctccactctaagtgaatcgcacgaattggggttttaggtacaacattcgaaatgataatatcagttgtttcagttggtttctcggtgatgatgacattcaaatcgaaaaaggttgcgatttgacgcttcaacatttcggtatagccaaacccataattaatatccagcgccacactgatgggttgatcgacaacgtgacgtggcacggttgcaattaacagatataaaatatcattgcaaaaatcaacgttgttcagtgtgatatcagcttgcttgtttgggtacgtatgagcaatccagtccatgaatgattgcgcgacggcttcgtagtccgcaaaattactgtctaggtaatcgttatggaacgtcgtcgtgacctcggattcggggtgattgtaacaaaccaagtgatacaaatagatgtcaatcggcgtcacgtcctgcttaaagaagaatggttgcagcgaccagtaagattgattaactgcgaccgcaaaagtcttaaccagttgctcttttaatggcgctgtgacgcgcagaaagttgggcactttgctaactggaataggcaacatgcgcaaactaatcataaagttcagatagccgtttgcttccagtgttagttcgtgctgtgataagtggatatttttacgttgtagcgattcatcgaaaattgcgatggtactagctaacatatcgtcatcaactagctcagttgcatcgacaaaaaatggccgtgcaattggcatgtgatccgttaacagatgcccctgcatgatgcgattgtacttcacgtaggtgtagtacaacaggcttagtttttgtgaatcagataaggtgatatgtagagcatttgaaattgcatcaataattcgttctgatgatgctttcaatttatcagaaaatgggtagctgaaatcaccaaacagcactgaataatgatggtaatagagctctcgaatcgtaatttcgtccccagttaagattaatgattctgacaagtctaaatgacggtctgcgaagtattcacggagaatcttccgcttgcggaaaaatgtcgtgcgcgagatagattcatccgctacatagtcttcgacagttgaaaaacattcgtggaatgagtgctcaactaatgcaatgtagtcggaacgtctcgaataggcgtaacgaagggcagtaattggcgaggcatttgagacgcgttggtaatgaacgataccatttgcaaatgtcaaactgaagtatttagataattcagttaacgcctccgcttccaaggtctgtaacacgccccttagcgtaaactcgctcatgtctagtttgagcgctaaactatgtaaactaatttttgttgattggcccatgctatccaaagatacaatgacttcaagttgtgtcttctcatgagcctgcaatagatttaaaacaggcattgttgtctaccgatatactttctctctttgtgaacttatagtaagttacataaaagattatcggttggctttgaagattttttgaagaaaacgcggtcgttttgtttttgtacgtaaaaatcggacactaggttgcggaccaaattgtgctgcttttcatgtaatcaatgcgacgcagccgttttttgaagatgataggatagacccatgctatgacagattgaacaatcttttgggggatagtgcaatgggacaaagtgctaagcagatgctgattcagtatatccaagactgcgaattttcaattgaatctgcgttaaaaatcatcgcgtatatgtcacggattaagacatatgaggatgtgccagacgttaagccagaactgcttgctgagttgagggaagacaatattatcttatagataagcccaacagctgctgcgataaaaacgccaattagccggtttcagcaaccgattaattggcgttttaaatttgacattattttacacgacggccgtgtaccaagtgatagatgaccaagccgattaccgtaatcgcaaccatcaccataaagagatgacggtagccaaggtaaggctcgaatagtccaataattgacggaccaaaaccaagtgacgcttcgtaagcaataaaataagttgccgtggcttgcgtcaaacggtcagctggaatcatttgtgaagtagtcgattgcacggcggattggaaattaccgaaaccgacaccgataaagatggcagctaacaacatcatccaaccgtttaccattgtggctagaagtagcaacccgattgctagaataaccaacgatgggtaaatgacatagttttcattcttacgatccatcaagcgcccgacgagcggacgagaaagcaagataacgaacgcgtacaccaagaagaagtatgacgcgaacgtcaccaagtgcaattgactagcaaagaaatccagatcagcttgcagggcagcgtagccaatcgttacaaaaccgagggttaatgagattggtagcacgcgtggttccatcaaagtacggatatcgaaacgttggttggcttgcttagcgaccggcttcgtttcaatgtaaaccttgtctgacttaacaaatagggaagcaattaaagcaataagtccagtcaagaactcaagccagaatagcgtactatatgaagcgtgttgcgtaatcaacaaagccaagaaaggcccgaatgctgtaccgaggatggttgccaaagagaagtaggcaattccctcggcgcgtcgctcagttggaatgacgttgattacagcggtattcgttacagtacctgtaatgccgactgacaatccttgaatgaaacgcacaacaagcaaataaatcaaaccgccttggagttgataggctagcagcacaggtaccaaaattgccatactaatgatggttaattggcgtgcgctgaacttggtggttaaaataccagctgaaaaacgcgcaatcattgtaccgataatcgtcataccagtcaccagaccagccatggcattgctaacgtggtaggttgccacggtgtatggtccaatgatgacaaagagactatagaacgtaaccatgctcaaaatttgaataacgaagagctgaataaacgttgcattaaagatacgggaatttgatttctgagacgcaataaacacctaactctctaataaaaactattttttagtatacacctcgaaaaaatagtcttcatagtttatcgttttagatggacaatttttgtattgaaaaacggcaattcagccaccgtttaaaacgtttaaccctgttcaaatcaaggctcgtgcatattttgtctttatttcgtgcagagtttattcttaaaaaaatcacaattctggttttataatgtaagtatcaaaagtgagaaaaaaacgttagctcgcaacacagattgtcctttttccgagtatggaagcgtgacttaatttgtgaagagcgttacaattaaatcacttataaaatgtaaataaaattccgattagaactagagtattaggagacagtaattatggcagtagcatcacatgaagtagtagcaaacacattgtgcgacaagtttatcgcaacgtttgatatcttgggacgtaagtggaacggattgatcatcgaagtattgttgaacaacggcccacgtcgtttcaaggatttggcacaagctgtgacgaagtgctcagaccgtgttttggttgagcgtttgaaggaattggaagcagctggtatcgttgagcgtcgtacatacgaagactcatcattgattgaatacgctttgactgagcgcggtgagtcaatgcgtcctatgatggctgccattcacgaatggtcagacaactggaacgcctaattaagcattaattgttaagccagtgaacaaggggaacgcgttcgctggtttttgcataccggttgcgaatgactgataatgttgtacaataatataagaaactttgaatgacctagtaagttggtatgtcgttttagagagtgggcactggtgaaaatcccatcgacgttaaaactgaatttcagtcaggagttcattggttgcaaggcctttgcggttcatccccgttaacggatgtccgagggtcgtcttaagtgacgactaaagtagggtggtaccacgttaatgagcgtccctgtgacaagttatttgtcgcagggactttttattttgattttattttctaaggagacaaaccatgagtttacaagacgagctcacgcaattgcgcgatcaagcattgggcgagattgaagcaacgactgacttgaaggctttaaaccaagtgcgtgttaactggcttggtaaaaagggaccgttgactgaagtgttgcgcggtatgaaggatttgacgccagaagagcgcccagttgtaggtgctttggctaatgaggtgcgcgacgccttgactgaggctattgcgacacgtcaaacgtcattggaagaggcagctttgaatgcccaattggcagctgaaacgttggacgtcacgttgccaggtcgtgcgactgtacaaggtcaaccacacgtgttgcaacaaatcattgagtcattggaagaccaattccttggcatgggttaccaagtcattgaaggtcctgaagttgagcaagataagtacaactttgagatgatgaacttgccaaaggatcacccagcccgtgatatgcaagatacgttctacatcacacctgaaatcttgatgcgtacgcaaacgtctcctgtgcaagctcgtacattggagtcacacgactttaatgccggccctttgaagatggtttcaccaggtcgtgtttaccgtcgtgacacggatgatgcgacgcactcacaccaattccaccaaatggaaggattggttatcgataagcacatcacgatgggtgacttgaagggaacgcttttggcggttgcccgtaagttgtttggtgaggaccacgaaattcgtttgcgtccttcatacttcccattcacggagccttcagttgaagttgacgtgtcatggaacgctgtgacaccagacatggcccctgaagacatcgagtggattgaagtgcttggtgctggtatggtgcaccctaacgttttgcgtatggccggtgttgacccagaagtttacggcggattcgcctttggcttgggacctgaccgtttcgcaatgttgaagtacggtgtcgaagatatccgtaacttctacttgaacgatgtgcgtttcttgacgcaatttgaccagaaaggataagcaaacaaaatgaaggtttctgtaaattggttgcgtgattatttgccaatcgagttgccagctaacgagttggccgagaagatttcacgtacgactgttgaaattgaaggacaataccaaccacaagcaaacatgaagaacatcgtgattgctaaggtgttgtcagttgtgcctcacccagattcagaccacatggtgattacccaagtggacgctggcgaggacgagcctatccaaatcgtgacgggtgccccaaacgttgctgaaggtcaaacggttattttggctaagcataactcaatcgttggcggtggccaaaagattaagaagggtaagctacgtggcgaagtctcaaacggtatgttgacggctttgcaagaacttggctttgacgacaaggttgcgcctaaggactttgaagaaggtatctgggtctttaacgatgttgatgccgctgacttgacgcctggtgaggatgccttgcatgttttgggtatggatgatgacgtacttgaaacgggtattacgcctaaccgtgctgacttgttctcaatgaacggaacagcttgggaagttgcagctatcttgtcagaagagcctacgttgccaacattcgaattgactgagacgtcagagaagacggctgatttgatttcagctacagcacccgctgaattggcgcctaagtacgccttgcgtgtcgttaagaatgttgaagtgaaggattcaccattgtggttgcaacgtcgtttgtggacgatgggaatccgtccaatttctaacgttgtcgatgtgacgaacttgatgttgttaacatacggtcaaccattgcacgcctttgatttggataccttgccaagcaaggacattgcagttcgtacggctaagcctgctgagaagattaagacattggacggcgttgagcgtgaagcatcagaaggtgatatcgttattgccgctggtgatgaagccttgatgttcgctggtgttatgggtggtgagttaactgaagtcactgctaagacgacgaacatcgttttggaaggtgccatctttgagccaaaggccatccgccacgctgctcgtgaccaaaacttgcactcagaagcatcaacgcgtttcgaacgtggtgtgaacgttgaagatacgtttacggcattggatcacgcggcagctttgattgctgaaatcgccggtggtgatgtgactgaaggtcgtgtggttgcgcaagactttgattacgaagccccagttgttaaggtgacgactgcccacgttaaccacgtcttgggaacggaaatcacggatgctgaaatctcagctatctttgatcgtttgttctttgactatgagttgaacgacggtgaattcacggtgactgtaccagctcgtcgttgggacatcacgattgaagctgatttggttgaagaaattgcccgtttgtacggttacgataacttgccagcaacgttgccaactggtgaaacgacgccaggtaagttgacaccaaagcaagctttgattcgtgcaacacgccacgatttggaaggcttgggcttgaaccaagcgatttcatacgtgttgacgacgcctgagaaggcaaataacttccaattgcacgatgggcaaccaatccaattggactaccccatgtcacaagatcgccaacaaacgcgtggtagcttgttgactggtttgcttgatgatgttgcttacaacgttgctcgtaagcaagctgatgtggctttgtatgagcaaggacgtgtcttcgtttctaacggggatgccaaccaattgccagctgaaatcgagcacgttgctggtgtgattacgggtaacgttttgccacgtacttgggcagaaggtgcacaaaaggctgacttcttcgctttgaagggtattgttgagcgcctattggccaactacgctttggctgatgatgtgcgctttgtgccaacaactgcgcgtgctgaaatgcacccaggtcgtacggctgacatctacgttggtgagacgttaatcggatttatcggtcaagtacacccattgacggccaaggcctacaaggttaacgaaacgtacgcctttgagttgaacttggatgccatcttcgacttgccaaaggtgaaggatggttacgaagtggtatcacgcttcccagccgttgcgcgtgacttggctatcttggttgaccgcgatgtaccagctgccgatttgcgcggggcaatcgttgccgccggtggtgagttgttgcacgacgttgaactatttgacgtttacacgggtgaaaacgtggctgatgacaagaagtcattggcttacgcgttgacattcgttgacgttgaaaagacgttggttgatgaagatatcaacgcagccgttgaaaacattacagctgcattggctgaccaatttaacgccgaaattcgttaaaaattgtcaatcaaatatttaaaagccatccgttactggtatactaactaataacggatggcttttttgctgtcattgcattttaaggagaacgataataatggaagatttgagccgcatcaacggtaagaagtcacgcaaagggctttggatttcgttggttgtgattgtgattctacttatcggtgcgggtgttggtggttaccaatactacaccatccaaaaggataagacggattattcagcattaaatgttaagagtaagaaggaagttcaagtgcaagttaagtatggtgccacggcatcagaaattgcatctgaattgagcaaggcaaaggttttgcgttcagaacgtgctttcatgaattatgtgacagtgaacaatgtttcggatttgaaggccggttactacttgtttagcccagctgataacgtgaagacgattgtgaagtcattgcgtcaaggtggcgctgcttacccattgaacggtaaggatacgattacggttcgtgaaggtgagacgattgaaaacattgccactgaagttggtgagaagactaacttcacgaaggatgagttcttgaaggccgttaacgaccaagacttcttcaaccgtttgaaggaagcttacccaggcttgcttgattcagaagtggatagccaacaagctggtgacatccgttacaagttggagggatacttgtacccagcaacttacgactggaagacagcaaagacggttaacgagttgatcaaccaaatggtctaccaagactacgtgcaaatgaaggacaagtttgacgccattaagaagtcaggcatgaccgtacaccaagttttgacattggcttcattggttgagcgtgagggaattgacgaagcaagccgcaagacgattgcgggtgtcttcgaaaaccgtttggcgattaacatgccattgcaatcagatattgcaacaaagtacgccttggacacaaacaagacgaacttgtctaactcagatgtacaatcagacaacccatataacttgtataagttctcaggttacggccctggtccattcaacaacccatcatcacaatcagttgatgcggttttgaacccatctgaccgtgataagggttacttgtacttcgtggctaacttgaagactggtaaggtttactactcaaaggactatgacgagcacttgggcaagtcaggtgatttggaagcaaccaaccaatcagttggaagcgaagctgatgcgaagaattcatcaaattcatcatcaaagtaatcacatacaataaagcatcttaagtatctgcttagggtgcttttttactgctttacaaagtggggcaaagctgaccataatggcagatggagaaatttgttttcgaagagatttaaaggaggcaacctgagtggcaacagcgctagaaaccttgaaacaaacgtttggctatgagtcctttcgtgatgggcaagaagaaatcattaatgccgtaatgaacggcgaacgaacactaggaattatgccgacgggtggcggaaagtcactaacttaccaaattccagctttgatgttgcctggcattacgattgtcatttcaccattgttgtcattgatgaaaaatcaggttgatgagcttcgcgaggctggtgtgccagccgtgacgttaaattcgacgcaaaatgatgatgagtactgtgcggcaatgaacagcttgttgaatgaagaagccaagttgctgtacatggcgccagaacgtctcggtagtgaagggacgtataacttattgaatcgcttgccaatttcattggtcgtcattgacgaagtacacgtgctctcgcaatggggtcacgattttcgaccaagttatctggcggccgttggtttaattaacaatctggaatcagcgccacgtgtaatggcgttgacggccacggcgacagaacgcgttcaggccgacttggaagagatgcttcatattcagcatactgtccgaacgagtgtggtacgtgacaacttaaccattcgcatggaaaagggcctgaataaaaagggtaaagaggacttcattaagacgtatatcaaagagcaccgtggtgaatcggggattatttacgcgccgacacgtaaaaccgttgatgcactcactgaatcgctaacggatgcgggtatcaaggccgttggctatcacgcggggatgtcagatgaaaaacgtgcgcaagctcaggatgatttcatctatgatcgtaccgatgtggtggtcgcgactaatgcgtttggtatggggattaacaagtcgaatgtacgctatgtcattcattatggtattccggggtcggttgaggcttattatcaagagattggtcgtgcaggtcgtgatggcttgccatctgaagcaattttactatatgccgcggctgatttgcagacgcaacgtttctttattgataacagtgataatcaaacaccggaatatcaaaacctgcagcgcgtaaagttgcaagagatggcgaattacggggcgacgcaaatgtgtttgcaacgttatatcactcgttattttggtgaggatacaccggattgcggtcgatgctcaaactgcttggacacacgtgaagcggttgatattacaaccgatgctcaaaaagtgttgagccacgttgtccgcatgttgaagtcacgcggtggtgagaacggcttcggtaagacagttacagctgaaacgctgcgtggtaaggtacctgataactttgcgtgggcgaatttggatcaattaccaacgtttggtattttgcgtggtacgccacgcgtgcatattattagcctaattgattatctgattgcggaaggttatctgcgcgtgactggtcaatacgctgggttaacattggcgccggatgcgatggctgttttgaagggtgagcgcaaggtgatgcgtcgccaagatattcgctcaattggcgatcgtgtgcgtgcaggttcaccaagtacgcgtgaagacttggatgagcaacagcgtaatgtctttgaagcgttgcgtaagtggcgtttggagctggcaaaggtgacggaaattccgccgttcattatttttaatgaccggactttggtggaattggctaaacagcaaccacttaacgatgcggagttgatggccgtttcgggaattggtgaagctaaagcagaacgttatggcgctgacgtattacgcgtcattgctgaaagtaaataatgaaaaaagggtcgcctagactttgcaacatgcaagtctaggcgaccctttaatttttaatgattaagcaacttcaacagcgatgatttcaacttccattgaagcaccgtttggaagtggtacttcaacttggtcgccgaccttcttacccatcaaagcaaccgcgataggtgattcgttagaaatcttaccctcaagtgggttagcttcaacggcaccaacgatggcgtaagtttcaggctcttcgtcaggcaactccttaaacgttaccttcttaccaactgaaacttcgtcgtcagcaatttctgatgaatcgatgatgatggcgttatcaagcatgttttgcaacgtgttgatacgtccttcaacgaaggcttgttcgtccttagctgattggtattctgagttttctgacaagtcaccgaagctacgggcgatttggatacgtccagtaatctcggcacgcgtctcagtaatcaacgtgtttagttcttcttcaatcttggcctttccttcgaccgtcattggaaatgtcttttcttcagccatgtttctggcctcctatgcaattaaattttattagtttaataagtgtgtatacccgaaggtttcaaatgttacattaccacgggtatgcgcgtgtgtaaaggttcacaacgctaagatttagtaatgcaatgagtgacgtcgcttttcgttctctgaccaacccaacccaagcatgaagagcaagaagcctaagctgacaattgcgcttatcttgaagtatggggcagcgaacttaaaggtgactgtatgctcacccggtttcaatggtacaccaataaagaacttcccgaccgttacggtttcggtttctttaccgtcgaccaaaacatgccaaccgtcagcattaggaatggtggtcatgagcaaaccttggccctttggcatattaattttaccgttgatttcagtttcagaatctttcttaacttgtagaccatgttcctgaagtgactgggcttgtgacttaatcaaatccttatcagcactgtaaagtgagacgttttgtaaccacaaatcatccttctttagaacgaacgtcagggtttgtttttgccccttttggtaagccggcagtggcacaacgattgtgtggcgatggctcggcatcgttggcaacgccttaccgttcaattgaatttccacattgtcattattaaccgcgtcgccaagcgttagataataaggattatcagtcgttggcgtgtaagttagggtcaatgacgcaacttgctttttgttttccttcttcagataagcaccggtaatcgttgctggtgcaggaacgttggcagcggtcgagctatcgaagttttcacttttaaagatgtcgtcgtgttggtaaccaattaaggcgttccaaaaatcattttgattgcggagcggatcgttgtccttaaacgtcacgttaagtgcatttgtgttcgctgcaaatgcgattggcagtgcgtaagggttctcagacaaaattgccatcccggtgtacttagtcatttgataagtaccattggtatcagtgcgctggtaggtttgcatgttagttggcgtacccggcgtattcggctccacaccagatggttgcaagaggtaacgcataccaagcaaactatcagttaacaatgttccgctactataagcgatgtagttatcgccttcgggttgaccgattgctgccatgaaatcactttgttggtgttccaaggcggaactaaaggttgaggcaccgttgtaattgccttgtagtgggtcgcccttcgtacgttggaatgattgcgcaacacggtagaagttatctttctggcttggcaagtgttgggtaatcttgttcaaactcttgatgtaagtttgatactcagtattcgtgaggtagctgaaattattcaacgtccaaacggtgctgacagtcatttcagcgataactagcagactcaagatgcccaaccaccaacgtgatcgatgtgacaacgcgtgtaatgccaaaatcaaaataaagaaggcgttacctactaataattggttcaatgtcaaaaagtttaggctgtcgaggcggaagtagaggtacacatcggtcgcaattgccaagataaccaatgttccaatttgcgtccacgagaagcgaagcgttggtgaccagactgaggctgccaaccaaagcacccaaaaactaaagacatatgagaaacgataggggtaccaaactggaaattggaacccgtgccacatcaaatccaatggggcgtacatcatggaaacaactagaaaggcagttacgatcaaagcagttagacgcgtttgccaacgaatcaatcggtaggtaaagaagaaccaaagaatgataattggcagactaccaataaaaatatttggcaaacctgacggcatttgttcgaagttaaatgttcccaagaacaacttgccgagtatatcaggcgcttggtattcgaacttccaagtcagattatccaacatgtgctgccccttgctattgagcaacgtataaccagtgggtaaccaaacgatagttgaaaggccaatgctaatgatgctaccgaaaatgaacttgctagcgatggtccaacgttcacgtaaggtgtatggttgccagaacaagcgccagaagacgtacaaaactaggaataggccaatcatgtaggccatgtagtagttaataataaagatggcggttagtggggcgataaatagccatgacgatttaccatctaaatagcgttcaaatccagcaatgattaacggcaataagattgcagcgtccaaccaaagtaggtttaagtcgttagcgacaaaccagcccatcatggcatacgtgacaccaaaaagtggcaaacgccagctattttgccaacgcatcacgcgcaacgcatagctgaaactccacccagccaaaccgtatttcagaacggtaattaacaagattgcggttggcaacattgtgttcgggaatggtaggagaagtaaattcgttgggctgaataaatagtaggcccaatcgccatacgtttcaccacccaacccctttgcgaagctatagaaaatactcgtgggattgtggaggatggcttgacggaaattttcaaaaaaatcaatgtattgttgccctaagtcgacggtcaagatggaacttgaaccgaacggggccatgtgacgaaagccaaaatagacagtcataatcaagagaggtagtaagaaactgacccatagcgcttgcgttgatgaccgccattttagtggattaaaacgtgcgaacatagttgttttctccctgaaattcagatagttctattaaaccatattctgcagtcgtttattagggtggcttttagttaaaatccgacaagggttaaggtttgttgccctggttttatgctacaattaaacaattagattatggaagaaagggtcaagttatgcagtcaccaaagcgacgtggcaatcgtcggtcaaagaatggatcattagctcgaattccagcacgtttgaatgtgctgatgggtatcgtggttttgatgctcggattattgggctggcgattagttaccctacaagttacagatagcgagacgtacaagtcagccgttaatagtgctgaatcaagtactgaaaaggtgaatgtgcaacgaggcatgatttacgacagtactggtcaagtgttggtcgctaacaagggatcacaagcgattacgtatacgaagccaaagggcgtaaccgaggctgagatgtacgacattgccaatgaggttgccaagtatatttcaatcgacactgatcaattgtcatcaggaaattatgcgacgtattacattcaagatacgaagcgtgcgacgaaggttgttaaggcaagcggtacgaagaccgtgccaggtacggatgattatgtcgctgccttgaagtcttacgtacaaaagcacgaggctaagttcccattgagtgataagcaaaagaatgctgccatgattttccaaaagatggcaaatgcgtattctttgtcaacggtctacattaaagagacgggtgtcacacaagaagaaatcgccaacatcggtgagcgtcaatcaaagatgccaggtgtgcgtgttggtatatactacacgcgtgactatccacaaggtgattcaatcaaggcgttggttggttcaacgtcaacttctaagtctgggttgccagaagatagtctcaacaagttgctaacggaagggtattcacgtgacgatattgtcggaacgtcatatctagaaaagcaatacgaagatgcgctaaagggaacgaagggtcaagttgaggttaccaccgacaaggacggcaagacgactgaaaagacgacgtacgccggtcaagctggtgatagtttgacgttgaccattaattcaaagttccaaaatgatgtgcaaagcatcttggagaacaacattccaggggggatgacaactggtgcgtatgccgttgttatcaacccaaagacgggtggtgtttacgcaacggcaggtgttaaccgtgataacgaaacgggtaagacgacgccggatgccctttcgactgttaaccaagcgaacgttgtgggatctgttgttaagccagcgatgattacaaccggattcttgaacggtacgattacggccgaaaataataccattaccgaccaaccgattacggttgctggtacggcaacgaagtcatcatggtttaaccgtaacggaagtggtagcatgcctttgacttctgacacggccttgatggtgtcatctaactcgtacgttatgcaattgatgttgaagatgggtggcttgaactacttcccaggtatgagcttgggagctttgccaaccagtgtgttccaaactatgcgtgatgggattgctcgtttcggcctaggtgttaagactggtattgatttgccaggtgaaattactggtgtgaagggttcaacgacccgtgaagacattggtaaggcgctggacgaatcatttggacagtacgacacgtttacgacgatgcaacttgcccaatacgccgcaactgttgctaacggtggttaccgtgttcgtccacacattgttgcttctattgaacaacgtgatgaagcgaaccgcgttaagacgcaaacaactgtgccaacagaagtgttgggaacggtcggctggactgaagcagagcgtaacttgatttggaagggtatggaagaagttgttcacagtagttctggttatgcaactggaacgcgtatgaagaatgttcaacctggtatctacgctaagactggaacggccgaaacaacgactaacggtgtttctacatataccagttcattgatttcattcgtacctaactctgatgttgctgtggccattgttgtgccatcggtttacgaatcagacgaaaacgttaaccaacaaattgcaatccaaatctacgaagcgttctggaaggacgtgcaagattctggttcagcaacaaagtaactatgctaaactgatacctattactaggtgtcagttttttgttagagagagggtgactgtctgatggacaagaatgaagctcgtgagatagctaagagtaatttagcgaagctgtttgatatgcaacgcgcgacgttaatgcaacaaataacaagtacagtgacagcattgccagcttggcaggaagcatcttcagtcgccttaacgttgtcacaagatgttgagttgcctacgcagcttttaattcagacagcgttattgcaaggtaaaaaagtgtatttgccaaaagtagcgccacaacgacagcttgaatttattcagattgatgagtcaaccaagtatgaacgccacagatttggtatgctagaaccaattggtgaaccgcttggggatgtggcgacacttgattttatcttggtgcctgggttggccttttcggcagcaggtgatcggctaggcttcggtggtggctactatgatcgttggttaccaaagacgactggcgcaaaaatcgccgtgacgattccagataattacgtgacgaccccaaattgggaaattgaaaaaacagatcaacaggtagataaggtaattgttttgccacctgtttaaggaagaaagtatgatagcagaatttaaacgcgcctttaaagcgacaccagcgaccagcgccctagtggcgtttatggtcgtggtgtacctatgggaagctttgattgcgcagagttttaccatcagttcacgtgttttgtatgaaacaggtgcgcaatttggaccaattgttctccattatggcgaatggtggcgtttgctgacggcaggctttttgcacgttaccgcgtcacacctaatctttaatatgattacgttgtattttattggccgattattagagttagaaattgggccttggcgttttctgattcttttcctcacaacggttatcagtgggaatttgatgagtttagcattcggtgcgatgaatgttatttcagctggtgcgtctggtggtgtgttcggtctattcggcgccattgttaggctggggttgatggacaaacgtagagcgtattggcgtagtcaggtaaaattgatgacggcatttgtactgttgtcagtcatttcagcactgtttacaccaggaattgatctggcagcccatattggtggcctgattggtggtttcttgattgtgccagtcttcatatcaggcttccactattcaggcttattcaaaatcggattagcgttgttgatgtatgttgtgttgattgccgcgttggttggtattgcactgttacgaaaataggagatagatatgcaaacatttttagatgtcctaaacttgttgaagaaatatgatatctacattcacgttggaaagcgcctatgggatattgagttagcggcaattgaaatcgataatatgtataaggctggtctacttgatgcaaaggaatatgcgcaaatcaagctggtcttacgacatgagcacgagttagaagagaagcaagaaagactgctataatagtattgaaaacgttttcaataaaacacttgttttaattcagaaattcgttataataaataatgttgaaagataagaaagcgattacaaaatatttttgtgagaatgacgaggaaaaatcatggctaaagataagctaattggtgttgaccttggtggtacgactatcaagttcgccattttgactgccgaaggagaaatccaacaaaagtggtcaatccgtacaaacattttggatgaagggtcacacatcgtgcctgacatcattgattcaattaaccaccacttggacttgtaccaattggacaaggatcgcatcattggtatcggaatgggtacgccaggaacggttgatcttgagaacggtactgttaagggtgctttcaacttgaactggaaggaaacgcaaaacgttcgtgagcaaatcgaagctggaactggtttgccattgacgatggacaacgacgctaacgctgccgcattgggtgagcaatggcgtggtgccggaaacaaccaaccagatgttgccttcattacgttgggaactggtgttggtggtggattgattaacgatggtaagttgatccacggtgttgcaggagctggtggtgaggtcggtcacatgatcgtcgagcctggtggatacttgtgcacatgcggtaactacggttgcttggagcaatacgcttcagctactggtgttgttcacttggcccaagactttgcagaagcctacgttggtaactcaaagttgaaggctatggtcgacaacggtgaagaagtaacgtcaaagattgtctttgacttggccaaggaaggcgactacttggcaaacgaagttgtagacaaggttgcttactaccttggattggcttcagctaacatctcaaacatcttgaacccatcttctgttgttatcggtggtggtgtttcagccgcaggaaagttcttgttggatcgtgttgagaagaactttaagcaatttgccttcaagtcaacgcgtgacgtgactgaagttaagttggctgagttgggtaacgatgctggtgcttacggtgctgcttcattggcccgtaactcagaccgcgtgattgcctaattaaataagtaaaataaagacgagaatcagtgatggttctcgtcttttttgttgtggttgtttgtgtgacacacaccgcaaattgcattgaactgtaacaaaattcccagaaaacgatgtaatgtttgtaataaatggcctgaaaagtaatgaaaacacgaaaaaagttattttcagagtagggactgtttttgaactaattgtgaacacgagaactgatgagcctaaatgacgggtttcgttcggtgtttaaatgtgaccattttgtgcgttacatgctgttcagacgctgttatataactgttacgcgccgtcggtatgattaatcatgttgttaaggcaacgcataacaaaaacaaatcaagttttataactattagaaacaaacgctttacacgagcaatatttattaggggaattaatcatgcaaaacgtaaattcacgcaagaagatgtacaagtcaggtaagaactgggtggccgccgctgttgttgctgcagccgcagctgttgcaccaatgatctcaactgaatcagcatacgctaacgaagaagttgcacaaacgacttcatcatggcgtgccaagacggttgaccaagtggttgaagccgttcaagccgccggacaaaagtacacggttcaagctggagatacgttgtcaacgatcgcatctgctactgaacttacgactgaagaaatcgcttcagctaacaacatttcagacgctaactttatcgttattggtcaagaaatcaacttgactaaggaagttgcagaagaagttgtttcagaagcaccagttgcacaagaagctgcagttgaagtggcaccagttgttgcagaagtagccgcacctgttgctacgcaagaagttgctgtttcagaagcaccagttgcacaagaaatacaacaaccagcagcaccatcatacagcgctgattacacggcagtacctggtaactcatactacgctggtcaatgcacgtggtacgttaagaaccaattgccatgggttggtaacttctggggtaacgccgcagaatgggctaacaacgcaacttacgctggccgtgttgtagacacgaacccagctgttggtacggttgcagttatgatgccaggtgttgcatacgcttcatcatacggtcacgttgccgtagttactggtgttaacggtgacatgatcacaatctcagaaatgaacgctaagggtgaattcgtggtttcatcacgtactatccctgcagcaggcgtattgttcattcactaatttaaaatgtattgtctatgggacattgtcatcaatgtcccatttttttgttatcgtgatgtaacttacttgatatacgcaattgttatgatagaaaccatacgaggctcagtcgttggactggctaaaaacgtacaaaaagggattataaacaatatgattaactctaagatgaatgctatggctaaaggaatgggagctgccgctttggttgcagctgctgcaattttgccaatgacgaactcaaacactgctgtatcagccgatgataacgcaaagccagctacggacgctacttcatggcgtgccaagacggttgacgacgttaaggaagccgttaagacggctggtacgacttacaagattcaagatggtgatacgattgacacgatcgcacaagcaacgggcttgaaggttgatgacatcgttaagatgaacaacatcacgaaccctaacttgattatcgttggtgaagagattcgcttgaacggttcagttgcacctgcacaatcaaatgcttcagctgcatcacaagcttcaacttcaacggctgcttcatcagcatcagtttcttctgcagcgcctgcacaaacgtcagttgcaagtgcaccagtttcaactggttcattcgctgacgccgttaacgctttgaacgcaatccgtacggctgctggtttgtcaccagtttcatacgatgcttcattgtcagcaactgcacaataccgtgcagacatgatggctggaaacgttgacgcagcacactttgcacaatcatacggtcacgaagttgttgctatcggcttcggtgctggttcagatgccgttaacgcttggtacgctgaaactggtatgatcgacaacggttcacacccacacacgcgttgggtattgggttcatactcacgtgttggtttcggttacaacgctgccactggtacgtttgttgctgaagctcaataattgaagaaaactcaaagtctgcctaaggttggcagactttttattttaggtttgatagaatagtacttgactgaaaaacgaaatggggaatttagtagtatgttgcaagcattgtttgtcattgtattgctttggattctttggacggttggtacattggtatggacgcgcgtaacgttgaagcgtgcggcatcacttttgaactctgaagaatttgaagcacaaagtcgtggtcaccaattgatcgatttgcgtgagccagctaagtttaaggcaaagcacgtgcttggtgcacgtaacattcaatacgctatgttgaatgagaaccacagtgctttgcgtcaagacaagccagtctttttgtatgacgaaaacatgcaaatggctgcgcgtatggcgcgtaagttgaagaaggcgggatacaacgatatctacgtcttgaagaatggttttggttcttacactggtaagactaagagcaactaaaaaaacacccacttacatgaactgacgtttgtacgccgaaccatgtaagtgggtatttgttttttatattcgattagaaacgtgcgccgtgagagtgagcagccttacgagcggccttgcgctctgtctcctcaaacttagcctcttcttcttccaaaggcttaacagcaaccttgtggaacgtgaaggctgcagcggcagcagttgctagcgtaccagcaacaccagtcaaaatccccaaaccaaacttcttcatgatgtggttcctccatatatttgttaagataagtttaacatattttatatgagtttaataactggggttctttgaaatgcagatgaacaaaccgttaattattgcccaccggggtgatcacacggctggacaacttgaaaattcactaccggcctttgcatctgcaatacaattgggtgcagatggtttagaggttgatgtgcagttgcacgaggggcgcttaatcctaaaacataatattgatgcgcatatgccaccggttgttgatgattttgcatcattcttagcgttggtgaaagagaccaactaccacggtttgttattgattgagctgaagggtaaacagggtgcagcgcaattgtaccgtgaattacaggctgcccaagttgatgcgccagtgatgttgcaatcatttcaagtcaacgcacttgaaacctagcgccgactggataagacgataccattagggttgttgcaacatcgacctaaccggttgagtcgacaactgttccaggccggcgtgattcaaaataataatttggactatcggtatttaccgtttatcttcgcgcgtgcccgggaagtggtgacttattggtggacaccaacgaaagcttgggtagtgaagatgatgttcatggcgcgcgttgccggtgtgattacagatgatgtgcgtttggcccaacaaattagagatagagatggaaaatagtatggataagttaattgtgattgtcggtccaaccgcggttggaaaaaccgctttatcactagaactagcgaaggaatttaacggcgaaattgtatcgggagattcgatgcaaatttatcgtcaactaaatattgggacagcgaaggcgacccctgaggagcaggcggtcgcaccgcaccatatgattgatattgctgaccccgcagaacactattcagccgcacgatttgtgcgcgaggcacaggcagcaattgcagatattgcatcacgcgggaaactgccaattttggttggtggaaccgggttttatgttcaagctttgttgggcgaccgtccgttagctgatgtggatgatattacggacgaggcatttgttgagaagtggacgacgattgcccatgaacaaggcgaatcggtggttcgtgatgccttacgcgaactggattcagtcagtgaggctcgtatcctgccaggacaaattcgtcgtttggtcagagcgctattagttagtgaccacactggcaagccgttttctgagcaacagccggaaccaaagcgtttatatgacgcctacatcatcggtttaacaaccgatcgaccagttctgtatgaacgtattaatacgcgtgttgatgcgatgattgcgaacggcctgctggaagaagctcagattgcggcgacattaccagaagacagtacggcgaaaaaagcgattggctataaggaattgtttggttacttagagggcgttgaaacccttgaacaagcgagcgaggctttgaagcaggcttcacgtcgttatgcaaagcgtcaaatgacctggttcaataatcagttcacggacattcattggtatgatttggtgcaaaatgctgcggaactaaacacgattgaagcggctgtccaaaggttcgtgtcagaatagctgacatgaacagaataatcttctaaaataggtggtaatatgctactcatagggggtcggacgtatggtaagacgagagttacgccgcgatttggcagtattgccaatgagtgtagtgcgcgaattgacgggcttatcagatcgtcagattcggtactatgatcagcagggactcattgagccacatagaggggccggtaagcagcgccgtttttcgttagatgacgtcgatcgcttattggaaatagcagattatctagatgccgggtattcgatttctgaaattcacgaggttgatgctaaaaagcaacgtcgtgaagcagaaaaagttaatccggatgaaattaatatgcgtcacatgttggctgatgagttgcttaagattggtcgttttaataacggtcaacggaagttttagatgatgtgttttgggataaagtaaaaggagattacaatggttcgcaaggcttacaccaaggatgatattcgcacaatgattgctgaggaaaacgtggaattcctacgtttgcagttctcagatgttttcggcacaattaagaacgtcgaagtacctgtttcacaacttgaaaaggtattggacaacaatttgatgtttgacggttcttcaatcgaaggatttgttcgtattgaagaatcagatatgtacttgtaccctgatctatcaacgttcatgattttcccatgggcgactgattcacacggtggtaaggttgcacgtttgattgcagatatttacacggccgaccgcgagccatttgctggggatcctcgtaacaacttgaagcgtgttttgaagcaaatggaagacgctggtttcaagaactttaacattggaactgagccagaattcttcttgttcaagcttgatgagcacggtaacccaacgatgaacctaaacgacaagggtggctactttgatttggccccacttgatttgggtgaaaacacacgtcgtgaaattgtcttggaaatggaaaagatgggctttgaagtggaagcggcccaccacgaagttgcgcctggacaacacgaagttgactttaagtacgctgatgcattggatgcagccgacaacattcaaacgtttaagttgattgttaagacgattgcacgtaagcacggtttgtacgcaacatttatgccaaagccaatttctggtatcaacggtaacggtatgcacacgaacatgtcattgttcaatgaagatggtaacgtcttctacgatgaagctggtgatttgcaattgtcaaagacggcctacaacttcttgggtggtgtcttggctcacgcagctaacttcacggctatcacgaacccaacggtcaactcatacaagcgtttgacgcctggattcgaagcaccggtttacgtggcttggtctggttcaaaccgttcaccaatggtccgcgtcccagcttcacgtggtaactcaacacgtttggaattgcgttcagttgacccaactgctaacccatacttggccttcgctgttatcttggcagctggtttggatggtgttgccggcgaaatggagccaaaccacgcggttgatcgtaacatctacttgatggatgaagctgagcgtaagaaggctggtatcactgatttgcctgatacgttgttggcagctgttaacgacttggacacagattcagttatcaaggaagcccttggttcacacatggcacgcacgtttgtggatgctaagcgtttggaataccaagcatatcgccaagaagtttcacaatgggaattggaaacttatttggagcaatactaaaatttcgtaaaaacttcttaaaaacaacgtcgtccagtccatggacggcgtttttctttaagtttaggttgtatgatatatatattaggtagatataataagttgagaagtaagattgcaaccacaaacaggaggggttgagatggagaacacgccatacttgacgacggacttaccgtcaaatcaatccgtattaaatggaaaattacaagcaaaactaaactacattggtgatattcaaactgccgtggcagaaggaaatgatcgccgtgtttatgaattactagatagccaaaagtacaacatgcaaattcgccaggcaccacaagccgagtcaaaccgtgtgttgtcagttttggttgatgatatgcaagatgagttgagccaccacttgggacaaaagcttattgcttacctatcagaaaagttcccgttcttttactatgaggagtcacaacttggtgtcttccaattgttctttggaaactggtgggaccgtcgtcacttcggtatcttggacccattgtcagttaagttcatttttaatgatgaagaatacgaaaagttggctcgtgcggttgaactagctgagtcaggtcaacgtttcaacgcccaagtcattgaagatacaacgcgtgccaacgaagccttgcaaaaggttgtaaacgaccaaaatgcacgtgatgctgagcgtacgcaattgatggcgcaattggctgccacggaagagcgtagcggtttgttcaacaagagtgcccaagcagagcaacgcgaagttttgcgtgcgcgtttggcccaattggatgcggctgatgctaaggcggcaacggttcctgatttgattgctgagaacaatgcccaaatcttgaactactcaaaggaagatacgattttgatttatgagcaacgtgcaattaacgatgcatttggctcgtttgctgatttccaaaacgcggtcggctcattgtatgtggactatgtctcatcattggtagccgaacagggaggtgagtaagcatgacagaacacctacgtgaacgcgttgtttcatacgttgatttgttgagcgatgatattggtcaaattcaacaaaccttagcgcaagttcgtgagcttgctgaaacaaacgatccaaagaaggtccacatgttggcgcaacgcctaacaaatgcgcaccttaatacagaatgggtgacagtgccacgtcaatatgcgaaggcagactggtacttgatggcgatggatcgtttcctttcatttgcggggatgccagcctatgatattttgacgccagctgagcgtgaagagttgacgttggtgatgactgatttggatgtgccagcaacctttgaattcgttgtgaacgacgataacaacggtggtgcttactttgttgagttgggtactgaggcgcgtctattttactggtcacttgagcgtaagcaaattttgtttaattctgaagctatcactgatttgatggttgaaaacttccgtaagaagacaacggcagcacgcattcgtacgttggctacgttgttgacggagttcggtcgttacatggagcgcgagttcggttatcaagtggactacaacattcttgaaacgcgcgatgatttcttgtatccattggtacaaactgaaatgccagcgggtatgttggatcgtttgtttgttctgtcagctgattcagactacttcttgcaaagcattccaaatggtgccggcttgatgttggagaatggcgttgaagtccgtatcttctacgttaacgatgcaacggcaatcggtgcccaacgttggcacttccaagtcattgatggtcgtgatgccatttcatggttagatgtcttgttggattatgacttcatcggggcttggtatttgacggaacgtcgttacttggcaattgagagtgatgagcttgtctttggattgcaacgtgaaggtctgatttcatatggtacaccagttgaaacagagcctgaggccgcagcttctgcagcgccacaagttgaagtgttgcaaccacaagcgtcagacgaggcggaataatgacgatggatattgcaggttacttgcgtgaagcacgtgagtcatatcgcgcagttgtggctgattgggaaaatccaatcgggcctaaggatgtcttgttgaatgattatttgaatttagatgtgtcattgagtgccttgatgttacgcgttgaagcaatcaacaatcatgtgccacacaatgcagtgacgccaagcaatgctgaagtgaaggcgttgtatgcgactgccttcgcccaattcttgttgattagtttgaagcagcaatggacgcacttgatggtgcttgaagatgaggacttggctaagttttcacgcttcccacaaatgcgtttggcccaccaatttattggtattaagacgatgttgctaaattcttatcaccaaaagcgccaagctgatttttcacatgcctggcggtcatttttgaaactcggcttagtcgaacttaaattgacacaggatgatattgatcaagaagttcgtgcggttttggacgcttctgaccttgattcaccagcgttttaaacgtacaatagatgagttggtaatttatgccaactcatctttttttgcagctgtagcacaactggatagtgcactcggtttctacccgagcggttgtgggttcgagtcccaccagctgcatgaaaaacttagaagtcctccacatttgtgggggattttattgtatttagttagaacttgttttataattatctacgttgtgtttgtggaatccacaaactgcaaccactcgtggtctgtattaagtagttccttggaactcgcggactcggtgagtctaagtttttttagaaaaatattttatggaggtctgcaaactcatggcagcatatgcaatcattgagaacggcggaaagcaatacaaggtttctgccggtgacgtaatctacgtcgaaaagatggacgccgctgaaggagacaaggtcgtattcgacaaggttgtcttcgctgacggcaagatcggtgcaccttacgttgaaggtgttactgtatcaggtactgttgagaagcaaggtaaggaaaagaaggttgttactttcaagtacaagccaaagaagcactcacacaagaagcaaggtcaccgtcaaccatacactaaggttgtcatcgactctattgcctaagacatcggaaagaagaggatttaaatcatgcaattgaatttgaacaacttgacgatgcttgcccaccacaagggaggcggatcttctgccaacggtcgtgactcagcaggtcgtcgtctaggaacgaagcgtgctgatggtcaagacatcaaggctggatcaatcatttaccgtcaacgcggtacgcacatctacccaggtgtaaacgttggtcgtggaaacgatgacacgttgtacgctttgactgatggtgtcgtaaagttcggtcgtttgggccgtgaccgtcgccaagtatcagttgttactcgcgaagagtacaagcaaatcatcgctaagtaattttagcgttataaaaccgctgtttataagcgttttggtcacttttggtcaccgtagcttatggacggcggtttttttgtagcaaatttatagtgcggctagattgctcagcctctttttctttaagcatgtgtgcataggttttaagcgtcacattcacatttgagtgaccaactcgttttgagatgtaggcaatatcaacgccattgtgaagcaagtacgaaacatgagaatggcgcagtccatggaatcgtattgctgggaagccaacttcttcggcaagttgcttcatccgttctgagaatacgtctctaaaccacttcttagggaataggacaccgccttcttctagttcatttaccaaagccaatagattgtcagtcacgtcaattgttcgattaccggagcgcgtcttagtttcggtattagacgcagttgctttggagtacgccttgttgatagtcatggtgttgtttgaaaaattgaagtcatctaccgttagtgcgagtatctcgccaactcgtgcaccggtctctagggcgataagaacagcaaagtagaacttgtcttcaatcatcaggtctgtatgatcatataaccaagattgcagtttttcaaaatcgctggcgcttaaatagttatcatcatcttttgaggcgccaccgtttgctttgagacgactgtaaatatctttctttatgatgccgtcaatttgtgcatcttttagtgaagccttgatagtggatacaatattgttaacgtaagctttggtgtgtgattcgccaaactcgttgattttattttggagatacaatgctgttaatttatcaagttgaatgtcaccaacaagtttatctaactcgttggtaaaactgcgatattttaccaatgtagatgcacggactgtgggttctttataagttgctacccatgttcggtagtattctgaaaacttcattttcgcagcgttgatatcagcaccgtcgataatttgagtttctagtttggcagcccattctgtagcctcccgtttggtatcaaacgttttgctaggttgctgacgattgccgcctgcatcaacataagatgcacgagcgcgccacttgttgccgcgtttagttatacttgccatgataagttaaacctaacctttacataaaaaatttaggcagtttaaagacatacccaggtctggtacaattaaatacgtaaatagggcagtaatgttctgttttggttgatacgcacacttctagcttggcggcgggggtgtgcgtgttttttgtttagtttagaataaaagcgcttattttttaggtaaaggtctagtcgttatataagtgtgcacaggtgcagtagacatttcgtcagaagacatagtcacagatactttaaggttttctgagactgatacgttaatcttaacgggggaaatcatagttttaacagaaaccattaccgtattatctggaaacaattgagttgggtcgtctttaattggctcgctatcaatttttacggtccgcactgcgtctccaaccaattctccagactcgttagtaattgagaatgccaatgtgtacatagtatcagcctttatacggtgaagttgtacgactatcggaaccccaatgaaaggaatatttgggtcaaaagtaactacgaatgcaggtgttccagaatctccctcggggtatattgatgctattttttcttgtagttcagtcattgtttttcctcattacttattggtgcttgaatgatgttatcattcaaattaattgttgaagaatcgtttggattattggaaccattgataaccgcagctgatccattggtaatgtttatgccaaacgagaagttggtgttattctctgaagtattttggacgtcactatctattttagcagatgctgattctgaaggttctgtcgagaagtgtgacagtttagttttaagtttggaaatttcagtagactgattttcaaacttgttattaattgatttcacccaatcattaacactaaaataaaacctagcaaggccaatgattagcccacctagtatcgtagagtccgttgcagacataccgaaaattctagtaagtgcagtggttagtattccaagaaatattgcttgtgcatttttgttttctaacataattttttggggtggttttatgaattataaaatcgatgacaaaagtaaatctatcatcgtaaatcagtttataactgctttaaagaacaatgacgtagtcgtaaatgttatcaataatggtactgcgtcgactgtttgggaaaatcagcatattaccgttcactattaaccagtatctcctttcacgccaccttagcgggtggctttttaatcatatattgcgtctttaacgagtggctcaaaccaactaggtaaattaaactcgttcataaagttcacccaattacgaaattcattaggagtatcaccatagaatagcttggcgacgatgcgaattgcacgttcgttagtaatacgttcttctttgttcttaatatagggtgaaaatgtatataggaaagaagggcttgaaaaggtgatatgcgtaatctcgtgagctaagcgaataaccaagcttatattagatttgtagttgcggttgatattgatgatacgttctttacagaatgcgacatctggatcgttatcaccgccagcaacttccgttattgttatattagattgtttagccatatatagtagctgtgaaaacaactcttcgtgcatatattaatcatttcccttcatggttttcagcatagccagaagggcttttttatattcatcagaaagaggttgtccatcgaacatagccataccttcttcggaaagtaccttgtctaagtcaacggggacgttttcgtccttcttattactgtgcatctcatcagtgttacctaataggtagtctactgatacgccgaggacgtcggccacggctttaattctatctacacttggttttttatccttccagctgtagatagaatttataccgatcccggctgacttagcagtttcttgaagacttaaccctcgcttttttgcgatttcttttgttctttcaaatattgtcatatcaacgtttccccatagttgacagcattattattactcaatcgagttaaaaagtgttgactattttattaaattgagtaataataaattcatcaagtaattgagcaacaaaaaacagacctaaaataatcaatgctttggcgagcgaatgttgatatacaggcgtttattgtgctttttcttatgcctttatattactccatcgagtaaattaatgcaataacttgataataaaaaaacagaaaggaacaagacgaatgaatggagattttaattttggaggaacagtcatgacttttgaaggttctgagaagcacaaacatggtctagaaaaaaacctttactttaatttagtcaactacaaaattgatcaagatatcgttgcaccgagtttgaaagacaacgctaattttaaagggaaactgatagttgaacttaattttggtaatttaaaagcctccacagagccacaattagctgttctggaggcgattggtaaacttgttgccactggtaaagccgagcttgattttactaataacggtcaactaacctcagaccaaaacctgtaaattgagcccgctcaaatgaatcgtacatgcgtgtttcatagacggatttatcaagcgaatcaagagaatctttgatgtcaatgatgggatattcattgaaaagttttcctgcttctggtgtgcgttcagtcccaattattttattagggctttcatctagaagcttcaaagctttgtctaagaattctttattgatagccattgttgtgcactacctttcgtcaatgtaggggagtgttgcgacactcacatcataaatattatcacaaataaacaaaggagattgcttatgacagcaacaacaattgaagaacaagaagaagcactaatgcgcaaagttaagaagcgcatcaaagatgaaatgtgggatcgaaatgatatgaagcaatttgaactcgcagagatgattggtgaaggggtttcacaaactaatcgtgcaatcaacggtaacaactcacctcggtcaaaggccattcgtaagaagattttcacgttgtttaacatcacagatttataaggagaaataaacatgacaaacgaactgattaaggttcaaacgaaccaagaaggtgagcaacgggttagcgctcgtgaactatataaggagttgggggttaaaactcgtttcagcctttgggtagatcaaaacttcaaaatgtttgttgaaggtgttgattttacaagtgtagttacaactacggttgttaataatggagccattcgtcaattagatgatttcagtttaacaactgatatggctaagaacgtagcgatgatgtctaagacgactaagagccaagaaattcgagactacttcattgcagttgaaaaagaacacaaggcgttgatgtcagacccacgtattcaaatggcaatgggcttgaagtcagctcaactgatgttagaccacaaggacaagatcatcgcagagatgacgcccaaggctttgtttgctgacgcagtatcagctagtcagtcatcaattctgattggtgagttggcaaagttgcttaagcaaaacggcgtagatatggggcagaaccgtttgttcggttatctccgtgaaaacggttatctggttaagcgacaaggttcagaccggaacatgccaacacagaagagcatggagcttggcttgtttgagattaaggaacacaaccacatcaattctaatggtgtgaacgtgactactaagacgccaaaggtgaccggcaagggacaacaatatttcattaacaagtttcttggtgaaactaaggctttattggaggtgtaggaatggcaagtcaataccagcttagtgatgaagacaaggaattgctacgtgaatatgggccagataactggcccccagttttgaccaagcatgagattgaattatatttcagaaggcaatgggcaacaatcatgaagacatacggaaagcgacctgattggccggtatctcaagtggctggcatatggcaggttcaattcaaggatcttcaaggatttacgtccgcctattttacgggacgcttatatgaaggtcttaaggacgtgcaatacggaggcaaatatacagatgactaacttattgatgggaatcggcttgatgttgagctggattgcgattgcaggtgttgcgttgtacttcgtcagcaagctaggagcacatgcaccggtcaaaccacgatacaagaagcgtattgaggcttacacgaacacgcaagccaagaacaagtatatggaggattgacgatgttatacattgcactttgggcggcgttcggcgggtttgcgttgatgattatcgcaatcaatttgttggagttgcttaagtggatttggttcaaggtaattggcccagctatctactattcacttgctgctatctattatgtagtgactggtgacgctgacgccttgccacgtcgctaacaaatgaatatgggtcgcacatcgcaagatgcacaccaaccacttacacgtaatattttttctcttactgtttgtctcttaacaacatgttggtgtgtgtcttggggtgtgcgacccagaaaggaatggaaatgaacgagtttggtccggagatgatttcaccgaaacaattgttttcaatcttcgtcgttcaaggtgtcgaaaacatgtacgacgaagagttggctgaacaattaggaactagcgtggctgcgttgaacatgatgcgtgaagcaaagtttgttggcatctcagtgccgccttggttggcgttgaatgtacatcgtctcttgtcagaaaagcaccatcttattgaattcacaaaatacgtattggaggacgatcatggcggattatgatattggatcaactggtgttgcgcatttgcatcactactttgcgccagataaggagtttgacatcgaagcagagcgtaagcgcattctgcaacataacggtcgtttggaacaccgtactacttgggtaacgcctggtgaaaatcaagtgaagagagatgagtacgaaagtcggtaccaagtgttcaagaagatgcgagacgcaggtaaatcatcaagtgaaattgcatcaggtattggagtgtctaaggtgacactgtcatcacttcgttatcgtggacgttacctaaaagaaaacgcctaacggctgcaaccgttaagcgtgaaaaatgagtaaatcttaggagtaatttactcctccagaataccacaaggaggtatgaaatgaaaaatgaattgcgattagaagcgcaaaaacgtatggatcgagccttcaaggcggaacaacgtgacaaccatgacgggactgtttcgaagtttgaaacgggcgttgctgacgttttgaactgggtggctgaccatgtttgatgaactacttgatccacctgatgatgaaatgccttggggagaagattttgaaggggacgaagtagcccaaggcacagaaggttggaaaacagaagaaggatttgttccggatgaaaaagaaaagctcaaggcctatatggaattagttgggcatcgggtaatagcggaggattgaaatgttgcgacgaaatgaatataacccagcacctgaactgatggaatcattagcgaaagtgcaattgaatatggtgcaaccaaccaagactaagtcaggtcactttggtaagtatgctgacttggctgatattgatagcgctgtacgactagcgattaagtcatcgagcgagccactagcttacacgcaatcaattaatactgacattgattcaaacggtaagcggatggcgcaaatagtgacaacgattacccactcatctggtgagtatattgatgtggaaggcttgcctgttgagtttggtacaacgccacaacagatgttggccaatacaacttatgcacgacgtggaagtctagcagctgcattcggaattgttgctgatgatgacgacgacggtgaaaacatcacggcattaaagcaagagcaaattaaacacgataatgtccgcaaggcgatcattgctaagttgaaggaagtcttgaaatcagttcctaaagagaagctggagcaagtgttcgctaccggaggtatgacagctaaggataataacgatacacaacttaacaagttgtcagccgacaaagcttcattgttagcaggtgctgcaatattcgctaagaacgacgctggtatcgagtaatggatatttgggggcgtgtcactaacatcagcggtaatagagtaacgatgtcggttgaagatgctcaagagttggctatgttgtcactctacacctcagaagaacgaccacaggcagttattagcatcgctgatgaacgcagtattagtcgtgtacagcgaaaaaaagcatatgcaattatcggtgagatagcgaagtggtcaggatatacaccagaagaaactaagtggtggatgaaattctattatgaagcagaaacaggtgatcaacatttttcatttgctgatacagatatgacaacagcacggaatttcatctcatacctgcttgattacgcagttaagaaccacataccgatgtctaagagtggtttggcgtatatggacgatgtagaggcctatatgtattcatcgttgagccaccgaagctgtgtggtgtgtggacgccctgctgatgtccaccacattgacaccgttggaatgggtaacgaccgaaatctggtagaccaccgacaaaagcatctaattgcattatgccgagttcaccacaatgaagcacacaacattgggtggccagcatttaaacagaaatatcacgttaagggtatcaagttagatcctgaaacattacaacgtctcggaatcatgacatttaagcgtatggaggaaatagacaatgaatcacgtctcgctaatcggacggctcactaaggagccagatgttaagtacactacatcaggtgcagcagttgcatcaggaacaatcgcagttaaccgagattttacgaacgctaatggggagcgcgagagtgactttatcaactttgtaatttggcgcaaggctgccgaaaattttgtcaatatgaccgctaaagggtcacagattggcctggaaggttcgtggcaaacacgaagctatgagaaccaacaaggacagcgtgtatacgtttctgaactagtagtaagtaactttactttagttgaaacaaaagagcagacagagcaacgcaaggggcaatcagcacaacaaagcaacggtgggttcaatagtacgccaacacaaaacaacttcaatggtcagcaagcacctcaacaagggggattctcgcctaatgatatgtatggtaacgacttaccaccattgaatgatgatgatcttccgttttaagaggtgaaataaatggcacaacgaagaatgtttagtaagaaagttacggacaccgacgtgttcttagacatgccactgtcaacgcaagcattgtacttccacttaaatatgcatgctgacgatgacgggtttgttgggaacatcaacacaattaagcgaatgattggcgcatcaagtgacgatgagaagttgttaattgcaaaacaatttcttattccgttcgaagcaagtggagtagtcgttatcaaagattggcgattacataactacattcgcaaggacacctacaacccaacaatatatggggaagacaggaaaaagttgtctgtatcagagaatggatcgtacatcgtgaacggaccgtcgacggatagtccacgtctcgtcaactaaccggcgacacaggttaggtaaggataggttaggtaaggataggttaggtaaggatagattaggctagtatggcccgctggctagccgctttcatagtatacggaacgatatatagcaaccagccagccaatggagtagctatgttaaatcaaaaacaaatcattattgaatggcaaaaagctgggttaaaagaaaacggctttatgtttcaagacattacgaacctgtatgaactagctgttcataatgctgattctgacgaagaagcaaataagctaatcatcttagcaattcgagcagccgccaaaaatggtggtaagacagcgatggctgttgagaataacttaaataagtggctgaatgctggcgctactaatgcaactaactcaatttttgttgtttaacagaagttaaacgaatttactagcgaattgacttcgcaaatgtttttgcatcaagaactagcttgatgaccctacacatttgtttcatcgaaacgatattcagttttcaatgacctacgtcgttgccttatcagacaacttatatatcttaacagttgatgaaacgaatgtcaacaacttatttgaagataatttttttgaagtgtgtcacgcggataactcgtaccccgtaacaacttaatctatattacagatacagttaccaattgtcaacactttcttcaaactttgttgcatatattttgcgcaaaaaagagcgatgcccaaatctaggcatcgctccttaattattaattgttattaacgcattgttgggaacaacaaaacgtcacgaatcgtatctgtatcagtcaacaacataaccaaacgatcgattccgattcccaatccaccagtaggtggcataccgtattccaaagcctcgataaagtcttcgtcaataccttccgcctcatcgttaccagcggcacgttctgcagcttgtgcttcaaaacgctcacgttggtcaattgggtcgttcaattcagtaaaggcattaccatattcagcaccgacgatgaacaattcgaagcgatccgtaaagcggtcgtcttcttcgttcttcttggccaatggtgatacatccactgggtgtccgtaaacgaatgtaggttgaatcaacgtatcctcaacaaacgtctcgaagaactcgttgatgatgtgcccaacaccccagtattgttcatacttaacacccttttcgtcagcgatagcacgtgcttcttccaacgtcattggttgccagaagtctacgccagtctcttccttgatcaaatcaaccatgtgcttacgagcaaatggctttgccaagtcgatatcgtgaccttggtacgtaatcttcaagtcatcagttacagctgctgcagcggccttgacgatgttctcagtttctaccatgacatcttcaaagttccagtatgcagcatacgtttcgataaccgtgaattcagggttgtgcttagggtccattccttcgttacggaagacacgaccaatttcataaacacgttccatgccaccaacaatcaaacgcttcaagtgcaactccaatgcgatacgcatgtacaagtcgatatccaaagcgttgtggtgtgtgataaatggacgagctgacgcaccaccagcttcgttttgaagcattggcgtctcaacttcaataaagccttcgccatccaagtagtgacgaatagccgtaatgatctttgaacgcttaacaaagcggtcgaatgaatcgccgttagcaatcaagtccaagtaacgttgacggtacttagtctccacgtcagtcaaaccgtggtacttgtctggcaatggacgcaaagcctttgacaagtgtgtgattgacgtgacgttgattgacaactcaccagcacgcgtcttcataaccgtaccagtgaaaccaaggatatctcccaagtcagccttcttcaacaactcgtattgctcttcacctacaactggcttttgcacaaagacttggacacgtcctgaacggtccttaatatccgcaaaactaatctttcctgaacgacgcttcgtcatcatacgaccagcgatagttacttcgatagcttgctcttccaaatcttctgcagttgcgttgtcatacaactcgtgcaattctgcagccgtgtgtgaacgctcaaagcggtgtccgaatggatccatgccagcttcgcgcatttcagccatcttgtcacggcgtgcgatcatttggtcattcaatgacacttcttggtcagccattatgttgcctctttttctttcaataatttgtgttggtatttctaccacagatacttattagtttgccaatattggccactttttgcaagtgcctcgcccaaaattacaatccttcggcatccttagctgcaataatacctgccaactccgcctcgtcgaattgaatcttcttgcccgtaaagcgatcaaccacttcgacaccgtggtcttcatcaagcatttcttgcaaatccttcattggcaaagtagccaacatgcgctcatactcgcgctttgaaatttcagggtaaagagatacttcagtcgtcgtcaattgcttaacgttatctttaccaaacaagttagccaacaaatccattggagcgtgaccttcaagcaattgtgatgagatagctggtacatgggccaacttctcttccaaagctgtaatatcctcatcagctgcatctggcaacgctgaaatcatgaacccaccagcggcagcaactgtaccatcaggatcaaccaaaaccgaaaccgcaacggcagaaggaatttgttctgacttggccatgtagtaagtcaaatcatccccaatctcaccagttaccaattgtacttgacccgtaaacggctcaccttcaccaaaatccttggtcactgacaagaatccgttgttaccaacagctccagcaacgtcttgttgtcccatcgccgtcaatggcaattcaacagttggattcgtcacgtaaccacgcacttcaccttgtgctgatgcttcaacaacaatcttacccactgggccgttaccgtccatgacaactgccaagcgttcttcacccttcaagacagcgtttgaaaccatcaaagaacccaacaatgcacgaccaagaaccgtcgtacccaattgtgatgcttcgtggaacgttgcaactttacgcatcatttccgttgcgtcgatggcaatcgcacggaagtttccgtcagtcgtcaccgcacgtacaagtgtatctgtcatcttttcattcctcttatttttcgtatatttctgtctaccagtttaacacattcaccatatagaaaagagacgtgaacgattactcattcacgtctctaatagtcattattcttgatcaagcttacgtggttgcaaaacttcagccttaacagctggttgtgcatcctcatcggccgtcaacttgctgttggcagcttccttagcttcatcatatgacattggcgtttcaacattcttttcaaccttggtcgtctctggcatcttaccagtttcgaacaagctcaagatttgcttctcatccaacgtctcgtactccaacaaagccttcgcaattgctgcgtgcttgtccttgtactcttcgatgatttcgtgcgccttgttgtaaccctcagtcgtaatacgacgaacttcttcgtcaatcaaacgagctgtctcgtcagagtaggcagctgactcaccgtatgaacgacccaagaatggttgaccaccattctcaagttgtaccataccaagcttgtctgacataccatattccgtaaccattgagcgggcaatgttggttgcttgctcaaagtcgtttgaggcacctgatgattgttggtcgaagatgatttcttcggccgcacgtccacccatcaaaccagcaatttgatccatggcgtccgtcttgttcatcaacatttggtcttcacgtggcaacatgattgcatatccgccggcgcgtccacgtggcacaatcgttaccttgtggacaacacgagcttcattcaaaaccaaaccaacgatggcgtgaccagcttcgtgataagcaacggtctcacgttccttggcagaaacaacacggtccttcttagccggtcccgcaataacacggtcctcagcttcatccacgtccttggcgtaaatcgtatcgtggttttgacgagcagccaacaaggccgcttcgttcaacaagttttccaagtcggctccaacgaaaccaggtgtttgcttagcaatttccttcaaatccacgtcgtcagccaatggcttgttcttagcgtggacgtgcaagattgcctcacgacccttaacgtctggacgaccaaccaaaatctttcggtcgaaacgacctggacgaagcaaagctgggtccaagacatctgaacggttagtagcggccattacaatgacaccttcgctacctgagaacccgtccatttcaaccaacatttggttcaacgtttgctcacgctcatcgtgaccaccgcccatgccggcgccacgttgacgaccgaccgcatcaatttcatcgataaagatgattgatggcgcagccttcttagcgttatcaaacaaatcacggacacggctggcaccgacaccgacgaacatctccacaaagtcagaacccgaaattgagaagaatggtacgccagcttcaccggcaacggcacgggccaacaatgtcttacctgttcctggaggcccctcaagaagaacaccagatgggatacgagctcccaacttcaagaacttcttaggatccttcaagaattcaacaacttcaaccaattcttgcttttcttcttcagcaccagcaacgtccgcaaagcgaaccttgttctctgaaggatcagctggcttagcctttgacttaccgaagcccatcatgttgccacgaccgccttgtccgccttggctcatgccacccatcatcaagtagaacacaccaatcatcaacaagattggcaagaatgaaatggccatgttaccccagaagtttgaagcttctggctttgttgtgatttcagtcttcgtcttatccgcagccttttgcaagctctccataattggatcgttgctaatgacttgggtttcgaatcctgtcaccttatttgaagcaccaccaactagtgagacaagagaatcatcctttgaactcttatccgtttgtgccttacgatattcacccttaacgtcataaacaccagcgccaggttgaatcgtgatggttttaatcttcttgtcgcgcaattccgtcatgaatgtcgacgtagagatagtcttcgtactagtcgtttgagaaggaccggctacccagtaaatcaaacccataataccgaggactacgattacgtagaacaaactattccggacaaaattgccgtttcgttgattcttcatctattcctcctacagatagttactactaccttcgttgcatcattattatgtttccgagacagaaattagtgctcaggcgtgatgtcgattgtatcgaccttgtccgcgtgggcaggatcataaacttcacgcttcaagacaccaacatatggcaagttacggtacagttgcttgtaatccaaaccgtacccaactacgaacgcctttggaacatcgaaaccgatgtaatcaaccgttgcttcaacaacacggccttccttcttatcaagcaagctggcaaccttaactgacttcgcaccacgttccatcaacaagtcgatcatgaacttcaatgaacgaccagtgtcgacgatgtcttccataatgatgatatcgcgacctgaaatgtcggtttgcaaatcagtgaccatttgaacttcacctgatgaagcaacgccaccgttataactagaaacgtcgataaattcaacttcagcgtattgcatgtgacgcataacgtcgaccgtccaaagtacggcacccttcaaaactgacaaaatgattggtgtacgtccttcgtaatcggcagccagttgcttaccaacacgctctgctgcttcggcaatatcagcttcgctataaagcacacgctcgatatcgttattcatgtcccattggttcatgtcttttcaatctcctaaatcttaattcccctatcgttacatagcattaagaataccatgtttgatggtaaatgtttagtgctacacctaaaagaaatgtgaacgctttattcttttcgtgaaagcaataagtagttttcgaaacgttctaactgcaagccattcccaaggtcaatgaaacctcgattaacattcggattgcgcattaactgaattgcttgtgttaactgactatcttttacagcaaaaacgtgttttttagtcaaccacgtctgcaaaaccagcaacaagaccgcctcgtcgacgcgccaatccaagcgaccatcttctaacgccttcacgtgcacattaatcgaaccactcgccagcttctgtaatgccgcaagttgatcagcgaatgcaatgacgtgatcctttgtttgctcgttaatttcttctagtgccggcacaacagtatgtcgcatacgattgcgggcaaacgtttcatccgcatttgtatagtcttcaacccattcaactaacggttcgttgaccaactgacccagcatcgctttatcaagttgcaacaccggacgaatcaaatcaatgtcaccctgcaactgttgctttttggccatccccaacaactgcgtcaaacgactgccgcgtgccaacttgtacaaaattgtttcgacctgatcacccttatggtgggccgtgacaattgcgttcgcaccaacttcacgtgcgatggcgaccaatgcctcgtaacgcttttcgcgtgccaattcttcaacaccagccgtcggcaccgtatcccaagtgagctggcgaatcgtcacgcttgccaaattaggtgtttgcgcaaatacgcgttcgactaaggcttgctcggcatccgcatccgtacgcaattgatgattgatgtatgccgcactcacaattggttgaatatcagccggcaatgaattgtccgttagccaacgcaaaacatgcagtgagtcttgaccacccgaaactgccaccaacacatggtcacgtttatcaaataatctttcttcccgaatcattcgcgttaaattagctcgcacaactttatcttgcatgattctctcccgttatttaatacttgccattattatatcgctaatcgaaaaataaaaagacaatcagtcgtctgattgtcccttttgttgattattatttattcacccggtaagttgaagacaacttcaccgtctttactgtacatgtacttttcacgaatcagcttttccagatacgaattatcgcccaagtctttaacttcttgtttgaggttcgcgttagttttgttagccttatctaggtttgacttcgctgtctcaagactctgagaagccgcctcgtacttaacgtactgcgtatggtaattaaccatcgcgaaaatcgtgacaacgaccatcaccgcgactaatacaacacggcgacgtaagtgcactacttgatggtaacgcatcttgcgctcttcaagatttaattggttggcgctcttagcgttcagcggcgtgatatttgattgtttgttaactgccatcattccgctgacctccccgagataatttgagcggacactctaatttagacctacaccattaaccaattctcctatgctcttactgtacagtagacaccggataatcttaagcaggattacctttccttaaccttttcgtatcaaaacctaacggatagttatccacaagcacctttcaccacatttttataacatttactaaaaaaagacgccctattttgggcgtcttttcatcttacttaattttcttcgttactgaagtcttgctcgtatgattctgacacaatgctatacatgtgttctgcttgttccttacgcacaacttcggccgtactttcaaccttaagtacagatgtcttgtttccaaaacgaatcgtcaactcgtcacccgtcttaacgtcattggaagacttcgctgtcttaccattgatatcaatacgaccttgatcggcgatttccttagcaaccgtacggcgcttaatgatacgtgaaaccttcaaatacttatccaaacgcattattttcttcctcgatttataaactgataaatttggcgacctttaggcaaagcatcccactctgcctcttccagtagtgctgtccaccacaacattaaaacaaaggcagtcgcaccgacacccactccaacgactgtcgtcaaaacactcgctaggcgcgtcgcaccaaataggctatgccctagtatatacgcaagacgggccaaaatgccaaccgcgagtaaaattgcaatcaatttgcgccaccatttctttggcacccaacttatccacaggcttttaggcaagcgaacgagcgtaaatattaagaatgggagcaatgcgccaaccgttgccagcgacgcaccagcgataccaaaaattggtaccaaccagatgttaagccccgctttcactaacatggttagtaagacaaaccagcccaagccacgcgtcttatcaaaactttgcaaaacacttgtcgacacaacaatcagtgtcgccggcacaatgctaatcgtgaacagcgccagtgcgtcactgccagctgatgaaccaaacaacaattgattaaccgatggcataatggccaccaatccaaccgtcgcaacaccggaaagtaaaatagaaagtcgcatcgtcaattggaaatcattacgcaacgcttgttcatcacgtcgaatgacatgctggcgcaaggccggcaacaatgatgtgccaagaccagttgccaagaccatccccaattgaaccaacggttgcccacgatcataaattcccttagtgaactcagcctggtgtgctgttaatccggcgtcttgtagcaataactttgttgagaacgaatcaaccagttgcaacaaaaccaacaatgccgctagcatcgctaacaacccaccttcgcgccacaaacgaccaaataaatggcgccagcttaatgttttcttctgcttgactgtctcatcaatcggcagtgaccaaatgtgacgtagcgacgttgctaagaataacgttgcggctagtccggcaatcgttgcaccaaaggttgcccactcaccaatccgatagacggaccagttggcttgaacaccccaccaggccaccccgataataatcgccacccggacaatttgttcaatcacttgtgacattgctgtcggcaccatgttcaattgtccttgcgcataaccacgtccgattgccaaaaatggcatgaaccagaacatccaggcaacggcgcgtacaactgggtacaatttcaaatcgccacccatcagcaatgacaagggcgccgcaccgccatacacaatcgtgaataacacggcgctaatgccaactagcgaccaaaacaaacgtcgtgccaccagttgttgatgcatttcatccggttgctctgtaatgatttttgaaataaacaatggccaaccactcaaggctagcaccataccgataccgtagattgggtagacctgctgataaacatagaaaccagtattaccgactaggttttggaacggcacgcgatacaccgcgctcagcaccttggcgattaagcctgacaccgctaaaacaccggcaccggccatcaaattctgacttgttttaggcattggcaactccttcttcaggagctagcgtgttaaataccgtcaacaagcctgttagccattcttcagccgtttgatttggttgaattggcacttcagccttaactggatctggcacgacaacctggccacgcaccttggctagtgccaacgcttgggtaaactgttgcgccgtaaactttgaacgggcatcgaacgtcacaaccaaaatgttttgacgcttaaagtcacgacgaatcgttgcaataccaacgcggtcagctgccgccttaagacgtccaaccaacaataaacgttgcgcagcttctggcaactcgccaaagcgatccaacaaatcatcttcaatttcttcgaactcagcggatgtcttagccttacgaatacgttgatacaaatcaatcttttgtggaccatctgctacatagtcggccggcaagtacgcttcaacttgcacatcaagttcggcatcgaacgtttgcttacgcttaccttgcttttcagcaacggcttcattcaacatttgcgtgtacaaatcatatccaaccgcgttaatgaagccgtgttgtgattgacccagtaggtcacccgcaccacgaatcgacaaatcacgcatcgcaatcttaaaaccagaacctagctccgtgaaatcacgaatggccgtcaaacgcttttcgctttcctcgttcaacgaacgcgttcccggatacgtaaagtacgcataggcaatattgtttgaacgaccaacgcgaccacgcaactgataaagttgtgccagacccatgtgatcagcattttcaacaaacagcgtattcgcgtttggaatgtccacacctgtttcgataatggttgtcgtcaccagaacgtcgtattcacggttaatgaaatcaaccagaataccttccatttgggcctcggtcatttgaccgtggatataaccaacccgcgcatccggtaccaaggactcaatcatcgccgtgacttgttcaatatcttccacacggttgtggaggtaatacgtttggccgccacgcgccatttctcgttcaatcgcgcttgccgtcacacgcccattttgttccataacatacgtttgaattggataacggttggccggcggtgtttcaataacagacaaatcgcgaacgccgaccatcgccatgttcaaagtacgtgggattggcgtggcagttagcgtcaagacgtcaacattcgtttgcaatgccttcaaacgttccttgtgtttcacaccaaaacgttgttcctcgtcgataatcaacaagcccaagtcaccaaactcaatatccttagacaaaatacggtgcgtaccgaccacgacatcaattgtgtggttcttcagcccttcctttgtctcgtccatttgtttcttagtttggaaacgagacatgatggccacgttaacaccaaacccatcaaaacgactcaacattgattcatagtgttgctgggccaaaatcgtcgttggcaccaacatcgcaacttgcttaccatcgtgcaccgccttaaaggctgcgcgcaaggcaacttccgtcttaccaaaaccaacatccccgaccaacaagcgatccatcggacgcgacttttccatatcagccttgatttccttcgttgaacgaatttgatcaggggtttcagggtatgggaaagcatcttcaaaggcgcgaatgacatcatcatctggtgcgaaggcatacccttgcttcaactcacgctcggcatatagctggagcaattcatccgcaatgtcttcaaccttcttagcaaccttggccttcgccttctgccattccgtgccacccaacttattaatcttaggggccttctcagccgcgccgacatacttttgtaccaagtccaattgcgtgaccggaatgaaaatcttcgcatccttttggtaggcaatcgtgatgtagtcctgcttaacgccacggttttcaatcgtttgcatgccttcatagacaccgacaccgtggttcacgtgaaccacatagtcaccgggctttagctcgttataactcttaatacgttccgcgtttgatagcgtttggcgcttaggagccttcttgcgaacttgctggaacaattcacgttctgtcaacacaatcaacttttgggctggcaattcaaaaccagcactcagcggcatggtcgtcacttgggttcgcccgggcgccaaagcatccggcgcaacctcattaattttgacaccaaagtctgccaaggtttggaccaacttagcttgtcgctcggttgtattcgtcaaaaagataatggtttcacccgacttctgccagcgtgccacttcactcttcagcattggcatttggccaaagaattgttgcgctggacgcaccgtcaaattcgtcaaacttgtctgacgcaattgaccaattccacgttgcaatggcgagaataccaaactagcttgttgcacatcacgcgccaaatctgccaattgccaacccaaatcaggatctggcaagacgcgttgctcggccatctcatctgtccaccaattttggttatccaacgtgatttgatcggcgttttccaacgcacgtggataatcatcaaacaccgcgataccatcagcaggcaaataatccaacagactcactgcgtcagggtaaaggatgtgcaaatattgacgaatttctggcaacaaaccaccctggctcatcattgacaataatgggctcatcgcttcagtcaagtgacgcttatcagcgccgtccaacttatcgcgggcttcggtcatggcaacttccaaatttgtcgtggctgttgctaaatcatccgcatcaattaccaaatctgttgctggcaaaatcgtgatgctgtccaggttttctaggctacgttgcgtttctgcgtcaaaactacgtagtgaatccaatgccgtatcaaagaagtccaaacgcaccggattgtcggcatccaatggataaacatcaacaattgaaccacgcacagcaaattcacccggttgttcaactgatccattacgctgatatcccatctgaaccaacttcgcctgcaactcagctaattcatagtcatggtcaaaatcaagcgtaatcgcagcatccgcaaacgccttaactggtggcaagtatcgcatgacacccgcaacgccagtcacaaccactgcctgtggatccgttagcaataggtgcaacgcttgcacccgagccaatcgcgtgtctaatgatgtcacggccacttctgtagataacgtttcctcagctgggaaaaccgcgacgtgttcatcacccaacatggcggccaaatcttcagctaattgatccgcgtgaaactggctatcaccaaccacaaccattgggcgttgggtttcttgttgtaatgccgccaaatacaccgtgcgcgcggtgccggaaatcccggtcatcaaatgacggccaccttttttcagaccagatgcgagttgttgaaactcagcatcttgctgaagtagacctgtaatttccatgctgtacctcttagttaaacttgttcatcaatgttggcatgtcagccccagatgcgaacgcctcaaagatgtcgagtgacttatcaataccaccaagcatctcaggctcttcatccttaccaaacttgcccaagacaaagtccacaacggccttttgtacgtgagcagggtgcccgataccaaacttcaaacgattgaaagtttgcgtatccaagtgttgcgcaatactcttaatcccattgtgaccaccggctgaacccttttgacgcaaacgcaaacggccaagatccatatccatatcatcttgtacaaccagcaagtcagcgatgtccaaatcgtagtaatccatcaatggacgcactgcacgacccgaatcattcatgtaagtcgttggctttaccaacaaaaccttctcgccatcaatacgcacatcagctacaaatgcgttatgtgccccatcttgcttaaaggatgcactgtacttatctgccaacgcatcaactgtcataaagccaatattgtgacgcgtacggtcatattccttaccaatgtttcccaaaccaacaatcatcttcatcagtatcatctcctatttgaaacgcgcgttaaacgcacgaaaggggcagagccacgatgaccctaccctgttaatgccttattgatactaatattttaccctatttcccggattagtgggcaaaaaataccgttgagataatgtacaaaacagcaatgtgcgttgggtaaaagatgtagaagaaccacttatctttacgtccttgcttgccgttatacaacgcaagcaacggtgtggcaaaaatcatcatccattggtaatcgctaaagccgtgcatggctgattgccacaacaagaacaagctaaagatgacgaaaatcgtcaaaccaatccaacgcttatcgcggaaaatgtggaacactagaccaagcaaaatccaaccaataccaccttcaactgtaagtgcagttgggataacgcttgaactcaagataatcaaaaacatgttttggcttgctgacgcggcgttcaataacgtcaacgccagaactggtccgaacaccaagaaggccaatcccaacaatccccatgcaaagcgcttaggttcttgctttgggtgcttcaaactatcccaagtccacatggcaataatcgttaagaacagcgtcccgaaaattgaattaatcatcaccacatgatcatttggcaaagcttgttgcaagatcataatcaccacattggtaatccagaaaccaatcaacagattacgcaaataaccaacccgactgtgcgtgtagtggaacccttccgctgccaagaacaagaagattggcgctacaatacgtcccaacatattcaaccaatctggtgcaccaacataactaaacatctcgtgcgtgtggtcagcgaccatcaacacaattccaatcattttaagcgtaaaactcgtcaacccatacttctcttgtaacttatcaagcatcacaatctctccgtatacctttatttgaacaatactatacattgtataatacgtggtggctaggatttaggcttgtttattttttccattaaattgaaattttaaaattagggtcggtggccggcttcgacacaaacaacaaaagaggtgcaacgccagaacgttacacctcttctaattattgttgcttaataatagctaacccagtcttgcgactaaattgcatcatttcgtgttgcccatccttgtggaaggcgtaaataagtgtatctgaatcaatcgcgtggcattcaaaccaatccgctgattgccaccacgttggtcgtgattgtagcaagcgttggaatttgttgaaaatctcaccgcgtggctcgtcccaagggaagtaacctcggttttcaggatccttaccacccgtcatccccatctcatcaccgtagtaaacacatggtacaccaggcatcgtcaaccacaattccaaggcacgcttcaacttctcttcgtcttcacccatttcagtgaacaaacgctttgtgtcgtgtgttcccatgttcgtaaacgccccgaaaaaggcattctttgggtagttagactccaaggtcatcaaaacggtcgtgaagacacgtgcatcgatttcttctagcatgaaatccaaaatcaggtttcgcaaaggatagtgcatggttgcttgcaacccaccgccgagcaagtattgacggcgctggtcgtacgcaaccttattcgatgcatcttcccaaacttctccaatcaacacttgttctttactcatctgatcacgaataccagcaatgaaatcatccggcagctcgtcggccacgtccaaacgccagccatccacgccaaagttattccagtggttaatcaccgagtccttatcaccgtaaataaacttacgataactcgcttcacttttattaatcaccggtaaatccttcacaccccaccatgagttgtactcatctgggaaatccgtgaaatcaaaccaatgataatactttgatgatgggccttgatatgcccccggctccttgaagtgaccgtccttattaaagtaacgcgaatattggccaacgtggttaaacacaccatccaaaataatgtgcatgccacgcttgtgcgcctcatctaacaaaaacttgaaatcatcctcgtcacctaagataggatctagcgccagatagtctgatgtgtcataacggtgatttgaattagcttcaaaaatcgggctcagataaatagcgttacatcccaattccagaatgtaatctagcttttctgcaattccttggaggttaccaccaaagaattcccaacgggcaatctcaccttgcttatcacgcacatagaatggcgtatcacgcttattcgcataaatgaacgaatttggctttggattgttaacgtgcatgtccttgtttccgttgttaaaacggtcaacgaagatgtgatagaaacgcgcctcctgataccattctggcaactcttccaactcggccatcaccgtaatttgaaagtcaggaattgatgcgtgatgcataccataaacttcagctgccccacccaagttatttccttgggcagccaaccagtactggttatacccatcaatcacttcaaaacgatagtaaagcaaaccggcatgggctgctgaaatttcaacaacccagttatcctcgtcttcttcatgcaaatcgtaccaagtgaccttacccgtttcgtcatcgtaaacacgtagccgtacttcttcagcatgtccttgcgtgtgcaacgtgatagtttcaccgacaataactgctccaaacggatcgcggtttgcgaccaaaaatgaatcaaactccatcgtggtcacaccttacttgctttcttgttgtgcaagcgccttgtgtggaatattccaaatttcatcagcatactcagcaactgtgtagtcagctgagaactctccgcttgctgcaatgtttgccaacgccttacgcgtccatgccgtcttgttttggtagtcttgacccaaacgtgtttgcgtcgcaacgtatgaggcgtaatcacccaagacaaagtactcgtcgttatcacgaatcaatgaatcaaacacggcacgtccttcttcttcgatattcggaatcgtaccgtcaatcaatgcatccaagacacggtgcaaaactgggttgttgtcataaataccttgggcagaataatcgtgcttctcatagtgtgagtaaaccgtatctgtatccataccgaaggcgtaggcattttcttcaccagctgcgcgaataatttcaatgttagccccgtccatcgttgccaattgcaaggcaccgttggccatcaacttcatgtttgatgttccagatgcttccttaccagctgttgaaatctgttcagacacatcagctgccggaataatcaattcggcaagtgataccccggcaagtgataccccatagtttggaataaagacaacttgcatcttttggttaaccgctgcatcgttgttgaccatgttggcaacttcattaatcaccttaatgatttgctttgcatagtagtatgacggtgctgccttagcagcaaagatgtgaacacgtggcgctacttaggcattcttgtcatgcttccacgccaagtaatccgtcaaaatgctgagcaagtgtagcaattgacgcttgtaggcgtgcaaacgcttgatttgcacatcaaagatggcatccgtgttcagctccaagcccatgttacgcttaacccattcggccaagcgcaccttgttctcgtgctttacatcctgcaactctgccaagaagtcctcgtcctttgcgaacttgttcaacttggtaatgtcctttggtaatgaacgccaactctcgccaatcttcgtatcaatcaaagctgacaaagactcattcgctgcatgcatgtaacgacggtgcgtaataccattcgtcttgtttgagaacttttctggccacaacgtgtagaaatcatgcaacaccttgtccttcaacaattcactgtgcaatggtgccacaccattaatagcgtgtgaaccaattgctgccaaacgcgccatgtgaacttgaccatcttgcaatggcgacgtgcgccatgcaaaatcttccccgtgttcgctagcgactgccaagcggtgacgacgatcaatttcttgaatcaattggaacaaacgtggcaattcagcttggaatagaccttgtgaccagcgttccaatgcttccgccaacaacgtgtggttcgtgtaactgaccgtacgcgtcgtgataccccatgcttcttcccagctcaacccatgttcatccaacaagatacgcatcatttctggaatcacaaccgttggatgtgtgtcattaatgtggatggctacttggaatggcaatgaatgtagtgaatacccatctgccaagtggtgcttaataatgttttgcacaccagctgaactgaagaagtactcttgacgcaaacgcaagcgacaaccttcttcattcgagtcatcaggatacaattcgcctgaaatactttccagaacactacgttcagaaaccgagacttgcaccccttccggcacttcagcagaccacaggcgaagcgtattaacgacatcattgttggccccaatcatccccgtatcataaggcacagccaaaacatcaacaccgccttggtataccggacgcaatccttctggcgtttcagccatgtagacgctaccgccgtagtgtacaacttgtgcttcactgtcttggcgaacttcccaaatgttgtcattcttcaaccaatcatctgggtattccacttggtagccattcacaaaggcttggcggaacaaaccgtaacggtaacgaatcccatttccgtttccagcaagctcgatacttggcatggcatccataaagtctgacgccaaacggcccaaaccaccattacccaaaccttgatcaacttccgcttccaacaaggcgttgaaatcaacacccaagtcttgcatcacttcttctgcttccgtcaacaatcctaggtttagcaggttcgcacgcaaataacgacctggcaaaaattcaatcgagaagtagtacacctgctttgcgcctgtgtctcggtagttttcctttgtacgacgccacttgctagcaatcaacttcttggccaccgtggccaaagcttgatagcgttgcaaatctgtcgcatctgccaaactgactgcgaaagtcccctccaattcggctagaaaactgtctttcagcatagttaccttatcgctttgttgcatacactcacctcaataatctttatagttgttcatagagttcgcgataggcgttggctgattgtgtccatgacacatcaactgccatcgcttgttcttgcaaactgcgccatgcttctggcttgttcaagaacgtttgttgcgcgtaatccatcatccaaccaagggtgctagcatcaaattgcttgaacccgaatccggttccctctcctgaaacctcgttatacggcaccactgtgtcacacaagccaccaacctcgtgtaccaatggcaacgtgccatacaattgcgccatcatttgtgaaataccacatggctcaaacgcacttggcattaggaacatatccgctgccgcatacatgcgctgtgccaaatgcacatcaaaatcaatgatgacacgtaattgatctgggtagtgcgctgccaagttcgtcaactggccttccagttcaggaatccctgttcccaaaataacgacttgtgcgtcgtgcgttgccaagaaatatggcaaggcttcggctagcaaatgcactcccttttgtggggtcaaacgtgacaccataaccatcaaaggaccagctgcgtgtggcaagccgaattcgtcttgcagcgcgtgcttatccttttccttaccactcatatcagttgcatcatagttaaatggcaaatctggatcagtggctgggttgtaacgttctgtatcaaccccatttacgattcctgatagtttaccttcgtacatgcgcaaaaccggatcaaggtgctcaccaaattcaggcgtcttaatctcttcggcatacgttggactaactgtgttaatacggtcggcgaataccattgccgtcttcaaccagttgctaccatccccaaagcgagcttctccactcgcgtacaaattccaatccaaatcgaagaacgtttgtaacgtttcaggcgcataagccccttggaattgcatgttgtgaatcgtcaacaatgtcttgatttgttgtagcggttgttgccaggcataacgcgtcttcaacaaagctggaatcatcgctgtgtgccagtcattggcgtgcaagacatctggaataaagtcgatttcttgcatcatttcaataacagcaagttggaagaaggcaaaacgttcaccgtcattccagtgttcgtaaagcttcttacctgagaaatatgattggttatcgataaagtagtagataacaccgttcaagcgcatcgtcttcacaccagcatattcctcatgattgttaatccacactgtaaaccagtgcaaatccatcaattggtcgcggtacttttctggaaaaatttcatggtagtacggtgcaaccacacgcacatcttcgccttgcgcatttagcgcgttaggcaaagcaccggccacatccccgaggcctcccgttttgtaaaacggcactacttcacttgcagcaaacagtactttcattagacagtcacctgcttcttggctgcacgcacaaccgcttccttgccaacaataattggcatttctggcgtaccgtgcaacacaacacccggctcaatcacagcgtccttgtccatgatgacatatgacaaatcagcatcagcgccaatcttgccaccttgcaaaataactgagtgacgcaccttggcatcttctgctacttcaaccgttcggaaaacaactgaatctgacacagacccagcaaacgtgccacccgttccaaacaatgaacggtgcacttcagctgatggcatgaagtgtgctggcgcctcgttctttgacttcgtatgaaccgggcgctccatcaacaagctacggtagttgtcaaaatccaacagcgccttgtttgcttcgaagtaactcttcacatcgtgcactggcaagtgaacgccttcgtgcacaacaacgttagcaccaaagtcgctcatcaattgacgcgtcaaaccttgaacattcttacccgtcgcatgttcgatttcacgatcagcagccacttgcaaaatgtttgaatcaacaatacttgcttgcaaataaaccaatacttgctcttcagatgaacgacgcacgttttcggctggctcaaagttacgagccaatccttcatcagtcaacgtaagcacttgcatacctggcaccaaatcagccacgtccatccaacgcgcaacaactgtaaccggttgtgcttgttcttcgtggttcgccacaattgacttcaaatccaagttcgccacttctgacgttcccaaaattgccgtatatggtgtcttggcgtgattaataaagcgacggatgtcctttaataaaccacgatctgactgaaatgtcataaataaaccaccgcccaagcgatccatttgccattcacgtcccgtacgaacgtggtccaaaattgattggcaacggtctggcatggccatcattgtctttgtgacacccgcattgcttgcggctgatagcgggaaatcaaccaatcggaacttaccaccgaatggcacgcttcccaatggacgatcaaccgtcaattgccccaaagtatggcagtgcgcttcattcaaatcgagaatgacacttaattgattacgcattcgacaataccccctcatttacttgcgtctctgcataatattcatcgcaaccaacaactgcgatatcatcaggcgttccaacaatcacggcacctggtgccaccacagcactttcaccaacgattgcgtatgacacagctgcgcctgcgccaatctttgctcctggcataatcacactgtgatcaaccactgcatgatcttctaccgtcacaccagttgaaatcaggctgtgtgaaacacggcccgcaacgtacacggcatcaaccatcaagctgtcgtgaatttgtgcttcttgtgccacgtacattgggttttggttcgtgctgtgtgagtagatacgccaagcacggtctgacaggttcaactcattgtcgcgttccaacaactccatgtttgcttgccacaatgattgaatcgtaccaacgtcgcgccagtagttacggaaagcaaaggcgtaaaccttttcgtcatttgccaagtaagctggaatgacgttcttaccgaagtcgaccatgtcctcaccttgctcatacccctctaccaagtactcgcgtagcttcttccagttaaagacgtagattcccattgacgccaagtttgactttgggttagctggcttctcttcaaattccacaatcttgttgtcgttgtccgtgttcatgattccgaaacgcgatgcttcgtccattggcaccggcataactgagactgtcaaatcagctcccgtctccttgtgcgcgtcaatcatgtcggtgtaatccatcttgtaaatgtggtcacctgacaaaatcatcacgtattcaggatcttggcggtcgatgtacccaatgttttggtaaatggcgtgggccgttccctcaaagaacttgtttccttcaccgtctgagtacggttgcaaaattgatacgccgccatccatcacatttagtccccagtctgagccgttcccaatgtgttggttcaattcgtatggttcatattgtgtgattaccccaactgacgtcacgtttgagttcgccaagttactcaacgtaaagtcaataatgcggtagcgtccgccgaatgacactgctggcttagccaagttcttcgtcaacttgcctagtcgtgttccttgtccccctgcgaggatcaaagccgttactttatccttcatttttctttccccgtgtttgcttcttttgcttaataatcaatgccccagttgcaggcaaaataactgaaatttcataatggtcaccggccaagaaggcttcgtgctccgttggaatgtgcttccaagtaccaccgaagtcactgttttccgtgtttaggagcacctcgtacttaccggccttaggcacgataacgcggtaatcattcttttgtaccggcaatgtattcatcgccatgatgagtgtgtcgttggctttcttaccacgacgcataaacgccatggtgccacgatacccttcgtcggtttgtgagaaatcaaccccttcaggtacaaaatcttgttcccacaaagcgtgttggtcacggtacaacttgttaagttcggccgtgaagtgttgcatgctacggtttagaccgtcttcaaggtcgcgccattccaatggttcttcatcgcgccattccaagaattgtccccattcactccccataaagcgcaacttcttacctggatgcatcatcatccaaaccatcattgtgcgtaggttcgcgaattggttataacgatcaccgaacatcttgtgcatcaaactcttcttaccgtgaacaacttcatcgtgtgagagtggcaacgtaaattgctcatcaaatgtgtacatgaagctaaacgttaagttgttaaatgcacctggtcggtaaaggtaatccagttcaaagaaatcaagcgtgtcatgcatccagcccatgttccacttgaagtcaaatcccaatccctcaggtgacgtcaccccagggtaggcagtcgcttcttcagcgaacatcaacgctgctggcacacggtcatgaataatcgcattcaacttttgcaagaatgcaattcctgcatagtcataagctgtgccatcttcgttgcgccagtcttccttacctgcatcttggttgatgtagatgatatttgacacaccatccacacgtaacccgtcaaagtgcacatcctctagccagaacaatgcggctgagattaagaaactttgtacttgtgactttcccaagtcaaagttccaagtgccccaacgcacattctcagcaatcgtacggtcaccagattcaaacgttggcgtaccgtcaaactggtagagtgcatcgtaattcttgatgaaatgacctggcacaaagtctaaaatcacaccaatattggctttgtgtgcttcatccacaaaatattgcaaatcttgcaagcgtcccattcgtgatgtcgctgcgaagaatccgtacgtttggtagccccatgacatatccaataaatgctccgtgattggcaacatttcaatgtgggtgtagcccatctccttaacgtacggaatcaattgatctgccagttcacgatatgacatgtatgacccatccatgtgacgacgccatgatgtcatgtgcatttcgtagatattgaccggttggttcaacttgtcgcgtcgaccttggcgaccacgatataagccatcatgccacttgtacgaatccgtgtttacaatcgccgcaatacccggcttcttttcgtattcatgcgcgaatggatccgtgcgtaacagcacttcaccatcacgtgtcttaatggcgtatttgtaataatcaccctcgtccaatacgtcagtcgtaacttcccaaacacccgtctcctctaacggggtcatagcaaagtcgtcgtgaatcgcccaatcacagtgtgccgacactaagtgaatttcttcggcgtgcggcgcccaaacacggaaagttaattcctgtccgttgcgtgttacacccaaaaatttatctgcgcgatatgactgaccagtattgaacaagtatgcagcttgtaagctttcgttcagtacatgtggtttcagcataatcatggtccctctttcttttccctgcaaaactgttcgtttcagagattgtcttttaatcatatgctagagatatgaaatccatatctgagaaaatatgttgttttttcacacttccgctcggacagttgccgaatttgttattttttgagcaaagtttttgaaaaaattttgaacacgcaaaaacgcccgctcagcaacctagccgagcgggcgtttcttaaagtatttaattcgtaagattttttatatctgggtttatgcttcagcaatatcttgcatcatgctgtagtggcgacggtgactgacatagtaaatcaccattgcaatgacagacacaacgaagacactaaacagtacctcaacttgtggcattgctgatccaccaatcatgattgtctcacgcaaaccatcgaccgtataagtcattggcaagtatgggtgcaaccactcaaagaaggcattagacaattgaattgggtatgttcctgctgatccactcaattggaagaccaatagcaccatggcagcaaacgcaccagccttatcgaaccacatgtagatagccgttactagcgcagcgtccatcaatgaaatcaatatcataaagccatacgtttgcaatggatgaattgggtctagtcccaaaatactaatactcaaaccatacaaaacagtcgctgccataacggcgataccgaacaacatcaccatctttgatcccatccaggcagccaaagaactaatcttcgtgcgtggtgaaatcatatcaagcatcaagttcaatgccatcataccgacgaacatcgcaactgagaacatgtatggcaccataccagttccgttattagcaacgtggtccttttcggtttgcttagctgttgccggtgcagcaatttgcttgaacgtcttgttagttgcctttgtatcgttaacttgcttagctgcagaacccatcttatcagccaacgtttggttaccagcttgtaccttggccaaagctggactcaattgttcagccccagccgtcaattggttagcaccgccattaagtttgcgagcgccatcagccaattgaccagcaccactactcaactcgccacgcttgctgtttagcgtatccagaccagtcgttaattgacttgaaccggccaacaattgactagcgccattcgataggtcaccagtcttactgttcaacgtgtttagaccatcactcacttgtgttgagccattcgtcaaagcgctaacaccatttgatagtgcgccagtattgccgttcaacgtattcaacccatctgacaacttatgcatattttcatctacagtatcaattgccgttgggagagccttcatttgctcaagttgcgtgttaacctcattcaaatcagtatttttagctgcctcacctaactgcatgatttgatctccgtgcgcattattaaacgtattaatttgtgctgaaagggccgcaatatccttaacaattggatcgatttgcttagaagtttcactgttattaacgtctgtagccaaagatgctgcaatcttcgccttttgctccggcgttacctgcacaccagcatcagcaaatgccttatcgacattcgctggcattgctgcggcatctttttcgcttgccttgttcaaattgtccaagtgcgtttgaacagtctgcaactgtgattggagttgcgcttgtgacggcatatctttagcaatatcttgtagtgttgccacttgcgtttgcaatgttgtaatcttaccagcaaaatcttgatccttcagttgttgattcaactgatcgacaccatttgtgagttgctcactaccggtagccagttggttaacgccactagctagcgctggcacttggctattcaattgacctagtcctgccgttacctgattacttccgtttgataattgtccaacaccacttaccaacgctggcacttggccgttcaattgacctagtcctgccgtcaatcgttggctacctgcatcagcttgcgccaccccgtcaacgtattgtgacaagccttgcgtcaacgtttgggcaccgtcgttaaattgcaacgtacttgcagataacgtctgcaacccactcgtcaattggtcagaacctgacttgatttgggttgtcccatcagccaattgcttgttggcatcagccgccgtgttcatccccttgccaactttcttcatctcagcaaaaattgtcttggcataagtcttagtgacttgctttgaaatttgttggctgatttccttagcgcctgattctgacaacttaccggcgatgaaactgtgacctgaactcgtctcataatcaagtttcatttgctttggatctttatccaagagcgtcgttgcgtccttagaaaaatcacttggaatcgtgatgactgtgtagtacttgccatccttcaagccggccttagcttctttttctgaaggaaaatggaaatccatgtccttcgacttgcgtagctccttttcaaggtcatcgccgactgcaagcttctgcccttcataagtgactgacttatccttattaataatggctactggtaagttcttcacctgaccatatggatcccataatgagctcaaaaaggttaccgcgtatatcgatggtacgaagaacaatacgacgataaccaacatgaagaacttgtgcttcttcaaatattcccattctgctttaaacacagtggctacctccctttttggttttaattccttttattgaacaacctgttgaataattaatttacttgtattatattaagtcttataaaaggtgagtacaatacacagttttgaacagtatgttcaataaatggaggggaacatgaaacaggcagaacgaaatgcacaaacacagcaactcattaaagaagctttcattcatttgattaatgaaaaaggctttaatagtttaactgtttcagacatcacgcgtgaagctggcgtgagtcgtggtaccttctacgtccactacaccgataagtttgaactgctaactaaaattgaagatgaactgattgataatatcgccgcagccttaacagctaacctagctgaaccgctgtctaatcacacgccggaagacttctccggtgcgccttacaaagtattcaaccaggcacttggatatgttaatcaagagcgtgatacaatgcgtgccttattatcacaaaatgggcatccccaattcttcaaccgcatcaaagaattggttgatcacctatttactcgtcagctaacccaaaatcatggtcgcttttcaagtgaactccccatcgattacaccaaagaaattgccctcaacagcattttaaatatcgtacgtcactggcttgataaagatgagccagagtcacccgaggaattggctgaaatcttgatgaagagtcgcttcatggctcctcacgaactaattactttcaactaatttaaccagtctaaaacaaaaaaccagccacgattggctggttttttgttttacatataatttgattttgataagtcttccaacgactccaagtggaaccccttgcgtgacagcaccttgataatctttgacaacgttccttcattaactgagtcaggcaacgtaaacaaaatacgcaccgtacgtgggttgttatcaggattcaacgtcattgatgatgaaatttgcgtataacgcgtaataatcttggcagccttttccaagctaccgcgttcaccatccgtcacaagcgtcaatgtgtagcgtccatcgtctgtttgccatgaatcagacatcaacttcatcatacgactgtgcgtcataatccccatgaaatgattatccttatccaaaacagagatgaatggcaaatcacgaagcgtaaagaacatctcgaagaacgtcgcttcaaccccaacgaacttcgtcatgttacgcatgtaagttgtcaccggcagattcatatctccgccatcaacttggtgtcggtagatgtgcatcttatagatcgcaccacggaacaattgaccactctcatccaagattggaattgcacggaaatttgagttattaaagatgtccaaggcatcttgcaacgtcgcattttcgctgaccgtcgtcaatacgtcacgggacttaattaaagttgctagcatttgtgccgactcccactttctagtttctaatctaattataataacacgattacagtactaccgcacctttttgtggaaagtatcacgaattcttctaaaataatgagaatcacctttgaactggaagttagtagccctacaccaccaactaaaaaagacagcaccaattcagtactgtcttcctatctattacaacttttcagctggttccaatgtgaaaccgtgccatggttgaatcaatgacaacaatgccatgtcctcggggtggatgtgaccaaccacattgatgcggccgtcgtttggcaaatcgcgtagcgcaatctgcaactcacccttgtattgtccatagtcgttgttgtcgataataacatccccacgcgtgacatcaactgtgttgaacgctgggaaatcttccgccttgtacttcacacgcgtttgcgttgagcgtagtacatagtcagaacgatcaccacgatacatttgtggttggtcatacaacacttgctttgaaaccttagataccaaagattcctccacaatacgtagcccaaccatcgtgcgattgaatgcttcagccgctgcttgcaaatcactatcatcagcaaatgcatccgcaatcaatacgtcatccaccaatccattaaagcgcaattcttgcacttgtgttgcgattggcaagttacggtgatcttccattgagaccaacccatcgctcactggccatggaccaaatgagccacttggcgcgtttacaaacgccgctgtgcgcaacccgtagcgacggtattgcattgacgtttctgcaaagtagtcacgtcccaatcccgtaaaacgttgtgggtagaaattgtgtgagccaatcaagttatcacggttaacaccaaaatccataatcaaatcgatatagtgttgaccacgtgacatgttcaactcaatcttcaacccatacggattatgcgtcatctgcgcttattcagcacccgtgaaacccaaatccaaacgaagtccccaagcacccatttctgagaataggcgcaaatccgtgtagcttgttccgagttgttcaaacaattccggattgatatccaaaatcgtcttcatccccaattcgtttccgcgcataatgacttgcttgtattgatccaacaaatccgtcatatctggcgtcaactctaacaatgatgtgaaaatgcgggtgtagccgtagctggccgccttttcgatgtatgcaatgttatccgccacgctggcacgtgatggatacactgaaatacctaattcccccattgattaggcctccgttaccttctcttgaaacgccacttcttctggcgtttcgtctgcaacttgttgcccttcaagtacttgacgttgacggtcaaccaacttgaagaatgggatgtatagcaacgtatcaagtacgaacaaaacaatttgcaaaaccgcacctgagatgtgtgaaccagtcgccaagaatccagaaatgattggtggcatcgtccaaggaatcacgacaccaaccgttgcgtgaacaatccctgttgccatcgtaacatatgcgatgatggcattgataactggtacaaaaataaatggaatcaacaagtaaacgttcaagacaactggtgttccgaacatcgttggctcgctaatgttgaacaaaccaggtggcgtgatcaacttagccaacgtcttgaattccttactcttagccgtcaaaatcatggcagcaaccaaaccaattgttgccccaccaccaccaaggtaaacgaacaaatccataaatggctgcgttacaatgtgtggcatcgttgcatcggcgttttgtgagtataccttagcgttttcagccatcaatcctagccagattggtgacatgatagcaccggtaacgttaccaccgtgcacaccgatgaaccagaacaatgacgtcacgattgaaacgacaatcgcgccggccaatgaaccaccaaaggctgacaatggaccacccaataccaattgcaagataccgtggattgatgccattggcgtagctgccaaaccggcgtagatagccccccaaagcaagacgataaccgctcccggaatcaaggctgcaaatgagtttgcaacagccggcggcacaccgtcaggcatcttaatgcgaatatccttcttcataaaccaagcaaagatgaccgttgaacccaggcaatcaagattgaggcaaacaatcctgcagctcccatataagtcaatgggaaaccttccccagccttagccataattgttggcgttgaaatgacgtaaccagacaaggcaatgatacctgctgatacaccatcaaccttcaattcttgtgcgtaacggtaagcaataccaaataccgctaccaaccccatcaaaccgaacgttccgttggtaatcttaaccaaccagtcaaacgttccgttatcaattaaccaagtcttgaacgaatcaattgagaacccgttggcaatcaacatcgtcaaagatcctacaataaccaatggcatcgcatacgcaattccatcacgaacggcattcaatgccttattggcagccaattttgaaccaattggcatcaaataacgttccagcaactctgtcactttcttcatggtgacatccccattttcctttatgcgcccattttatcgaatgaaaacggatacaaaaggaataaattgtgaatatgtctagacatacaaaaacagctagccaaatggctagctgtcttgaaaaactattttcctgtcttcgtctttgtgaaaccaaagagccaaatcaaactcaacccagcaaataccgtgctgaaccagaacaaatgacccaacccagttgctgtttgatgcgcaatttctgcaggcgttgtactagttgtcttaataaacaaggcggcgactgccgttccaaccgctccagcaaattgctgaatcgtattgaaaatggcgttaacgtcaccagaaacctcacgaggaacttcagcaacaccagccgtcattgacgtgttgaatgctaagttacggcctaacgtgaacaaggcgtacatcaccgtcaaaccaattgacgtaattgatggtgccatgattgaaaagataaccatgaccacgaagaaactaattgaaccaatcgtcaatggctttgtcgccccggcgcggtcataaaatgcaccgtacattggtgatgaaattgatcccaacaatgaacctggcatcaacaccgcaccagcgaccatcgtcgttgcacccagcgtcaattgcgcatattgtggaattgcgaagttcacagccaagttaattgcttgtgacgttgcataaattaacaacgcaaagaccatccccttgctcttgaatactgacaagttcaacaacttctttgttgacttaccgtcaatccgaataaatagcaccatggccacaacagcaatcactgccaacacaataatcgtggctgaaatcttaccagattccaattcaccaagtgccaacaaagccgtcgtcaatgacacacccaaaacgatgaattgccaccaatcaaagctagcctcttcagcttggtgttcacttggcaatgtgcgccatcccaacaccaaactaatcagcataattggcaatacgatgacgaaaattgcacgccaaccgagccaataggtcaccaaacccccataaactggtccaagtgcgggcgctagtgacaaaatcaaaccaccaaagcccatgtacttgccaatttgcattggtggaatactcatcaagatcacgttaaagaccaatggcaaagcaattccagttccaaccgccatgattagacgaccaaacaacaacggccagaaacttgggacaaaaatggaaataatatcaccgattacaaatgaaatcataccccaaataaaaatcttacgcggactcatcacagcctttagataggctgatgtcgtcatcatcaacgccacaatcaacaaataagctgttgttagccattgcactgtccccattggaacaccaaattgcttaattaaatccggaaatgtcacgttcattgacgtttccgtcaaaataccgacaaacccaagaatcgctgtcgcaacaatcgaccaaacgactcgtggtgaaactttttctgtcattttctcactccttttttgaacacttgtactattgaagcataaaaacaaattcttcgtaagtaaaattttccttaagttctaatcccaacaaaaaagctcggaacactacgttccgagctatatattttattcactaacaacgattgcttcaccagcttgtagggcattcatattgactgatggattgagtgcctgaagttgtgccaatgttaaaccatgttgcttcgcaattgaataagctgttgcgccttgaggaacggtaatcgtcgtccctgttgcggctgaactgcttgactcagcttcggtttcactagcggtcacttcagctgaactagtgcctgattccgcttcattaccagtttgcgcctctgattccgttgttgaaccatcctcacttgctgatttttcttgatcgctcgaactgcttgaggccaccttagctgtttttgtcgtttctcgttgtgccccaccagttatactattcatcaaaactggtagcgtgaaaccgacaacaaacaaaacaatgtaacccaaaattacgagtagccaaaactttaatcgtcgtggttgctttgtttccatggttaatatttccttattctacttaattcttaaattcagattatcacttagtttatgaaaaaagaacagttcgttgttggcaacaatgtttttttaaacactttggcctttttgtgaaccgacaacagaaaagaggacgacacatcactgtatcgtcccccctcatttttaattacttagctgaacgacggaatgccaacaactcgtgtgagatttcagcagttgcgccgtaaacttgcttgtagatagcgtggatttctgcgtaacgtgcagcgcgatctgcatcgggcaagtattccttgtcaaatgagttccatgcagcagcagcgtcttgaacagtgtcgaaccaacccaaaccagtagcagccaagattgcagcacccattccaggtccttgctcgttcttcaatgaaacaaccttcttgttgaagatgtcagcttggatttgcaaccacaatggtgacttagcaccaccaccgatggcaacaacagtatcgaagtcagtaccagcttcttcgtagatatcaaagatgtccttgaatgagaagataattccttccaaaactgaacgaacgaagtcagacttcttgtgcgttccgtcgataccagtccatgaagcacggatgtcaccgtcagcgtatggcgtacgctcacctaccaagtatggcgtgaacaacaaaccgttagcaccaaccgttgacttaccagctgattcaaccattgccgtgaagtcttcatcagcagcaaacgtcttcttgaaccatgacaaagcgtatccagcggccaaagtaacacccattgagtagaacttgccagggatagcgtggttaaagaagtgaaccttacccttgtaatcagcatctgcgttgtcttcgtacttcaaaacaacacctgacgtaccgattgatgacatcaccatgttaggttgcaagattgcagatccgatggcaccagcagcgttgtcggctgcaccaccgaataccttagtatcagtcgtcaaacctgagaaggcagcatactttggtgagatagtaccagcgaattctggtccttcgataatctcagggaagaattctggcttcaaaccaaaggcttcttgaacttcctttgaccaagttcggttagcaacgtccattgcaaccgtaccagcggcgtcagaaatttccatcgccaacttaccagtcatacggtaacgcacgtaatccttaggcgttacgaatgaagcagcttgtgagaagatttctggctcgttttccttaacccacaagatctttggcaaagtaaatccttccaaagccttgttacgcgtgatatcgatgaattcttgacccatcttctcagcgatttccttagtttgtggcgtagtacgtgtgtcgttccacaagattgctggacgcaaaacttggttgttgtcatccaacaaaaccaaaccgtgcatttgacctgagtatgaaataccagcaatgtcttcaggcttgatgccgtcatccaaaatcaaacgtacgatggctacagtcgtaccgttaacccaatcttctgggttttgctcgctgtatcctggctttggttgtgatagtgggtaatcatatgattgttgtgcaacgatgtttccttgacgatcaacagctgagatcttaactgatgacgttcctaggtcaacacccaatacgacttcgctcatgtttatgtcctctttctttgttatgtatacaacgagggctgggctaatttaatggcccagccctcgtcgccgtagggattggccctactgttatgtttgttgcaatgtgagcgtgagataggcactcacatcgcttttgttgagattatttttgagattttttgagattgagagatgctacatcgaccattatttcaaaaggagtcgacgtggcggtgctaattttgcattagcgtaagccttttcttaccaggaacctattcggttgggattactttgagaaagttgaacccaaaactgagtagatgtagttgttcaacgtagccttgatagcttccaaacgtcctgattggatcgttgagaagatctcgtcgttcgtcttgttcaagatgtaagcttcgaagtcagcgaatgaagccttgtcgttttcgaagtcagcaccgatacctgaatcgaatgatgaataacgctccttgtagatgttctccaagaagttgtcttcgatcatcttcatagcaacgcggaatccagcagcgtaaacgtccataccggccatgtgtgcgtagaacaagtcatccatcttgaatgaagcacggcgaacctttgagtcaaagttcaaaccaccagttggcaatccaccgttcttgatgaactcgtacataaccaaagtagcttcgtagatgtcgttagggaattcgtcgatgtcccaaccagtttgcttgtcacccatgttggcgtccaatgaacccaacataccagcttcacgtgcaaaacgtgcttcgtgctcgtaagtgtgaccagccaagtaagcgtggttaccttccaagttcaacttgaagtcgttttccaaaccgtacgtcttcaagaaggcgatagtagtttgtacgtcagtgtcgtattggtgagcagttggctcctttggcttaggctccaacaagaattgaccagtgtagccaatttcgttagcgtacaacttagccaacttgaagaacttagcgatgtggtccaactcacgcttcgtgtcagtgttcaacaatgactcgtaaccttcacgaccaccccagaatacgtatgattctgagttcaaacgcttagcgatttccaatgagtgcttaacttgtgctgctgcgtaagcaaatacgtcagcaaatggcgtagtagctccaccagccatgaaacgcttgttagtaaacaatgatgaagtgttccacaacaacttcttgccagtttccttcatcttttcttcgatgcggtcaacaacggcgtccaagttagcgttcgtctctgccaaagtgttaccttcaggagccaagtcacgatcgtggaatgcgaagtattcaacacccaacttgtccatgaactcgaacatgtagtcaaccttagcgattgcgtggcccaagtcagtcatgtcgtcaacaccgttaacgtcccatggacgctcggcagtaccttcaccaaatgggtcaaccatgcgttggtccatcgtgtgccagtaagcaactgagaacttcatccagtccttcatcgtcttagtctcaccgttgatagtgaaaacctcttctgggttgtagaagttgtatccctttgatgcttcaaagttcaatccctttgctccgccgataaattctaccttaggaaagtcgaacaattctgacattatgtcatcctccaaaattcttaaatcatctgttttaatcatcaaagccggttggctttggttagttggtttaagcaatcaactaacttacgagatttattatagggtacctattcacagaatgcaagcgcttgtatgtgattaatttcgcaattcgttcaaaaacatagaaaaaacgcctaaacataggcgtttagacgtttaaaattataaaaactctaatttttgaatacgctttcattagcgcatttgtgcaatttttacaaccaattagactcggctgcgtcttcttcttcgagcacgaagtttaactcgtaacccatcatatccagcaaagtacgcgttaccaaggcaacaccaccagaaagcgtggcacggttaactgacttcttagcaaagtacaaaggcgtttccgattcaggttcgatcttgcgatacgtctctaataggtaatcaagcaactcaggtgtaccagcaatgaagcgcgaatgaacaaacactgcttccggcgctgcgtactgtgccaagttataaattgtgcgacagattgcatggacccattcatcaatcaatgattttgcatccgcatcgccacccatatataagtaaagaaaatcttcgcgagtaatttcttcttggccttttaatgaagctaagcgactaagcatcgcatcttcagcgtataaatcttctatatgaatagtatcgtcaaaatcacccttagccagttgatcgttgttcaatacaacctgacgaccaatttctcccgcttcaccatgtagcccacggaacaaacgaccattttggataattccagcaccgataccgttgtggatattaacaacagtaaagttttggaatatttcgtctgaatcatagtcatgatagtcacgcaagtagatggcagccaagttggcttcgttttctaatataacaggtacgtgtagtgcctcttccaaatccttggccaagtcttcatttactaattccgtatggaacggcgtgtagcgtaccttgttatcttcgacaacaccgtggatggcaaccccaatcccgattaatccatgatccgtttgcatatcacctaactgtgcaatatatgaaagcatcgcacgcttgtaatcagcatagcgcatcccaagcacagtcatttggccacgagaaataacttcaccagtaatacgggccaccaagtagcgtagatgattgcgtcccaagtcaaatgaaacaatgtagccatagtgacgattaaagcgaatcaattttggcttacgtccaccagcctttgaaacggttccttcacctaattcttctatatatccatccgcttcgacgtcacgataaatcgtcgtgaccgtcgatttatgtaaagcaatctgttctgcaatttcactacgcgacgtttgctgcgcattaaacaacgcttgcagcatcagtttacggttcgtatcacgcatcgcatcttggtctactttagaaaccattctttctcctccatattataggtagttattttatttttggcctatccctatcaccaaattaatcttcatttcacactcaagtattcattctaccgaaaaagcggtcgtttgtacggttaatttcttaatatgtccgaattatgtagacattcccaataccgggacggataaatgaacaaaagtggcatagtttgtgaatattttatcacacagttagttgcgttgctaaactaaccatgttattattactatgcaaaaggaaatgataacgttttcaaggaaaagctcacgattacacatattttcatttccccttttgacaaacatctctctcacacatttttaaggagttattcgttatggatgcaaacgtaaagaacgacgagtttgcaaagctttcaatgatggatcgaatctcttacggtttgggtgatttcgctcaaaacttgattttcggtactgtcggcggattcttgctattctatttgacaactgttgacggtttgtcttcagctactggtgcaatcattttcacgattgttcgttgggttaatgttttctgggatccttgggttggtacgacggttgaccgtcgtaacccaaagggtggcaagtacctaccatacatccgaaacttcggtatcccattggttatcttggctgcaatgctattcttgccagttggacaatggttcccagcacttaaggtgccatatgccttcttgtcatacttggcaacggctatgatttactcattcgttaacatcccatacggttcattgaacgcttcattgacgcgtgataacgatgaaatcgctaagttgacgacggttcgtatgatgttggctaacacggccaacttgttggtttacacattcttccctatcttcgtgcaattggctacgtaagttggtcgcgaatcaaaggatatcggaatgtttggtattcacttgaacttgggtaactattcttcaccacaatcagctggttcatggtttaaggtttatgccgtatacatgattatcggattcttggctttgatggttacttactcaaagacaaaggaacgcgttttgccagacaagtcagaaccacaagttaagttctcagacttgtttgctgaattgaagcgtaacaagcctttgcaaattttgggtggattcttcttggttggatttacgttcaacttccttggatcaactgcatggccattcttcttgcaatacaacatcggccactcagaatggaacggttcaatctcattgattggttcaattcctggaatccttttggtttcactttggcccgtattccgcaagatgttcggtaagaagggattcttctacttcttccttatcttgttctcagctggatcacttgttttgtggtggtggactaagaacccagacaacatcgccttcggttacattggtcgtttcctacaacaatggggattgacttcagcaactggattcatgtgggctttggttcctgaagttgtttcatacggtgagtacacgtcaggtaagcgtgttgctggtatcatcaacgccgtgatgggattgttcttcaagattggtttggctttgggtggtatcttgccagccttcatcaactcattcactggattcaacggaacaaaggcaacgcaatctgcttcagctttgatgggattgcaatggtcacttgtttgattgccaattatcatggctgtcttggctgctatcattatcaagatttacccattgactgacgataaggtctttgagatgaaccgcgaaattgaagcacgtcgtaacaagtaatttgtaaaaacatttcacgaaaagccgttaacctcagggttaactgcttttttggtacttatgccattcttgtgaatattttttcaagtggttggttgtctaaacaaactaactgtgttatattatgtgtacacagtaaatggtaacattttcacggagttgttcagacattaacattatcgttaaagtccgctgtataaaagggttaatcagtgattgaaacttttatacagcgcatctcacgaactgcgttgctgcccgactctcacacgtatcgggacacatacacactatatctcacaaggagcatctcacaatgcaaattcaaaatcctgtattgcctggattcaactcagatccatcaatcatccgtgttgaagacacgtactacattgcaacgtcaactttcgaatggtacccaggtgtacgtattcacgcatcaaaggacatggttcactggaacttggtaactaacgttcttgatcgtctagaattgttggacatgaagggtaacccttcatcaggtggtatctgggccccagacttgtcatacgcagacggcaagttctggttgatctacactgacgttaagatcactgacggtgccttcaaggatatgacgaactacttgacgactgccgagaacatcgaaggtccttggtcagcacctatccgtgttaacggagttggtttcgacgcttcattgttccacgatgaagacggtcgcaagtacttggtacaacaaacttgggatcaccgtgaataccaccacccatttgatggtattacgttgactgaatttgatactgatacgatgaagttgaagccagaaacggctcgcacgatcttcgaaggaactgacgttaagttggttgaaggtcctcacttgtacaagatcaacggtgaatactacctattcgctgctgaaggtggaactgtcttcactcaccaagaagttgttgctcgttcaaagagcttggatgagaagtcattcgttgttgagcctgatggcccattcttgacgaacttcgacacgccatacacttacttgcaaaagcaaggtcacggtgctttggtcgacacaccaggtggtgagtggtactacgcatcattgactgctcgtccatggaaccacgagactgagtcatcaactgacccacgtggatggtcaactttgggacgtgagacgtcaatccaaaaggttgaatgggacgaagctggttggccacgcgttgttggtggacacggtgggcaaacgttcgttgaagctcctaaggatgctatcttgactgaagctcctgcagaccactcacaacacgatgagtttactgacgctaagttggacatgaactggaacacgttgcgtgtaccattctcagaagagttcggttcaactggtgacggttcattgaagttgatcggtcgcggatcattggttaactaccacgacttgtcattgattgctcgtcgttggcaagcattctacttcgatgctgaaactaaggttaagttcaacccattctcataccaatcaatggctggtttgacgaactactacaaccactcacactggtcatggatcttcattacgaagaacgacgaaggtcaaagcgtaatcgaagttgccgagaacaagggtggacaacgtaacggaacttacacgtcatacttgaaggacgatgctatcgttatccctgaaggtactgaatacgtatggttcaagacgaaggttcgtaaggaatcatacacgtacgagtactcattcaacggtactgactggactgaagtaccagttgtattggacgccgcagtcttgtcagatgactacgttgtacaatcatacggtggattcttcacgggtgcttacgttggtttggcagctgtcgactactcaggttacgacactactgctgaattcgactacttcgactacaaggagcttggcgacaagcaacttgaagacggatcatactcatgggaagcttcagagtcacgcttcggctaatatctgaataaccaaaacgcctaacagattttctgttaggcgtttttttgcacccttttccttcatcagacacattgtgtgtcgtatttcgcacacttttttgtgaaaataataacaatcactattaacaattccttttagtaagcgtatagttgtttatgttgattgagttgttaccgttttcataaatagtgaaaaaagtaacgttaatctagaaattatcttttagaaagcgagtatgcaaatcatgcgtaaaatctcacctcgtttaatttattttttcggagccctaggtggtctcctattcggttatgacaccggggttatctcaggtgacattctctacgtgcaacgtacccttggcctaaacgccttggaagaaggaatcgtcgtctcatcagttttgcttggcgctatgattggtgccatgtcaatcggccctctgtcagatcgcttcggtcgtaagaagatggtcatggttgcagctttgattttcttcattggatcgctaggttcagccttttcacctgaatttggtgttttggttgctagccgtgtcgttcttggtgttgccgttggtggtgcctcagcccttgtaccaacctacttagccgaagttgcgcctgctaaaatgcgcggttcactaacctcacttaactaactgatggttatgacgggtatcttgatggcgtacttggttaaccttggtttctctggcctagcacataccgtgtcatggcgctggatgcttgggttcgcagccctaccatcagcaatcctattcatcggtggtgttttcttgcctgagtcacctcgttacctaggtcgtattaagaaattcgatgaagcgttgcaagttttgaacatgcttcgcacgcctgaagaggctaaggctgaattggctgaaatggaaaacgctaaagacgtcaagcttggcggcttcaaggaattgttctcaaagttcgttcgtcctgccttaattatcggtgtcggtatggctatattccaacaattcatgggtatcaataccgttttgtactatgccccaactatttttaagaccattggcatgggcgatagcgcctcactgatgggaactgttggtcttggaacggtcaacgtcttgatcactgcctgggccgttcgcgtgatggaaactcgcggtcgcaaggaatggttgttgattggtggtttcggtatggccgtttcattgattgccttgtctatcctaactagcctatcagttacaggcatcatgtcatacgttacaatccttgccatggccttctacctcatcttcttctgtgcaacttggggcccaatcatgtggacaatgattggtgaggtcttcccattgtctgtccgcggtgtcggagttggtttctcatcattgattaactggggggcaaacctacttgtatcattgatgttccccgttttgttggaacacttctcaatgccgattatcttcggtgcctttgctgttatgtgtgtccttggttcactattcgttaagcacttcgtcttcgaaacacgtggtcgttcgcttgaagaaattgaaagcatgcttcaccaacgcgcgaaggattctgcaaccggtgctgtgccacacggtgcgatgattcaacattaattactatgaacaaaaccggtatcagaactaactgataccggtttattttgttaaaataaatactatcagtgtcgaaaggagtaaccgaatttgaaaaaagcactaaatgccatcttcaataaccgctatgtgaaaaccatcattgacgtttcgatgcgtgtcgatatcgtaacggctagttcttcggttgcttactttggactattgtcgattttcccagcgattatcattatcgcgaccttattaccctactttggactaactatcacgacagcccttagttatgtgcaatgggccgtgccaaaatctgtttatggtttcgtgcgcccaattatcgagtcaattctcggacataatggcgttggtgtattgtctgcatccatcgtgattacactttggtcactttcacgtgtcgttgcttcaatccgcactgcccaaaatggcatctatggcgtgcagccaaagaatattgccatcatcgaccgcttcatttcaatggcctggatgattctagttcttggtattatgggcattctcatcttgattgcttccgttggatcgaacgttcttgaagcattgccaatcagcagtcacatcgtccgccaaatcgagtccgccaagttaccagttgttgctactggattgttcattggcgccgctctcttcaattgggtactaccggtcaaaaagccccgtttacagtgggctttgactggtaccaccatccaagttgccctcgttttgtggttaacgaagattttcgggtggtacgtgaacctggcctcacaggcttacaccttttatcaagcccttagttcggcaatcatcgttttgctttggattaatttcattgccatggctgcgttgattggtacaattgtcacagcaagtttagaggaacttttcccctcaaaacgtgataagaaagccattttgaagcacttcagtagaaaaattatccgaaataatggaaaaagttaagagttatttattgtataattcatttttgcgcgttattataatatttgttaaagaggaaaacgtttccatttaacatttgagacagcaacttactcatatcgccgagtctaaccagctcggcatgtaggtctaaccaacctacaacctactccttaagaatacctatttaccatggattaaccacctatggtaacgatgcgcctaaccaacgtatcgttaggaaaagagtcgtcttcggactagactccgaaaccgcctatgcctaaccaacataggcggttttgttttgcgcttttttccagtaaaatcaagacaagaataaaacactttggggaagtgcgaaaccatgaacacttatgaacaacgcgttctacagacctgtgcgcaggctggacgcatcttactagaaagcggtgcggagacgcctcgtatcgaagaaacagttgaaattatcggcaagacggccggtgttagcgtatcctgctacgtgacactgacggctgtcttcgtatcgctcgctgatcagccaaccactcaactaaccaagacaaagcttgggagctttaacttgcaaaaagttgatgaaattaatcatctctcacgccaattcgtggctggtgacgttgatttcgatgacgtcacgcgacaagttaacgccatcgatgaatacgcgattgatttcaactggcccactaagattatcggcgctggcttagtatccgtcgcaccaatgttggttttcaaagcaaactggctcgatttatccctcgccttcttcgttggtattgccggctacctagttgcacagtacgttggacgtaaagcaaccgctacaccttatgccaaggaagttgccggtggctttacaatttcgctattggcgtggctgttagtcgccggtcacctgggcacaaatgccgagaacatcatcgtaagctccgtcatgccgttggttcctggcgttgccttaacgaattcattacgcgaaattatggctggtcatatgatttccggtacagttcgagcattggacgctttgttgattgcagctgccatcggcggtggcgtcgtcttagctgctaccctagtccactttggcacgacattataggaggtaatcaaaatgcaattaatcatccattttctgattagcttcgtttcgacagtcgggttcggcatcatcacgaacatcccccgtcgtgctttaccagttgccggtctaaccggcgccttagcttggagtggctacattgcctacggttacgcacaagacaacgtctttatcgctaatatgattgcagccattattattggtttgcttgggaatattttcgccgttaagtaccgtgtaccggtcaacatgatttacattcccagcctggtttcactagtgcccggtggcactatctacttagcgatgaagaacttttcgttagggcattacgcattggcacaagagggcgttatcaccacgcttaccatcgccgtcgctttagcggtcggctttgtgctatctgaagtcgtggtccgccaagttaaacgttatcatcatcactaaaaaaacgccttggacttaaaaatccaaggcgttttaatttactattttagtgcattgtaagcatgccagctgttcccaaggccaatacaacgataccaacaacgattcggtagtatccaaagaccttaaagtcattattcttgatgtagttcatcataaccttaatcgcgaagtaagccacgatccatgaaacgatgaatccaactgccataacaccagcttgtgcgccagtgaagctaccaccatcaaggaggtacttaccaactttcaaaatcgtcacaccaaacataactggaatactcataaagaatgagaactcagcagccacgaatcgtgacgctcccaaaatcaaggcgcccaagatagtcgcccctgaacgtgacgttccaggtacgattgaaagcacttggaacaaaccgatgaacaacgccatcttgaacgtcatcgtgttcaagtcagtcaaccaagcatccttgttagccaagtaacgctcaacgacaatgaacaaaataccgtaaatgatcaacatagatgccacaacccaagcattcaaccagtgcgcatccatgtagtcgttaagtgccaagccggccactacggcaggcaaaacaccgacaatcaccttgaaccacaaagtccacgtttgcttcttttcaatcgtagactttgatggtgcaaatgggttcaacttgtggaagtacaattggataaccgcgaaaatagcacccaattggatagcgtagtcaaacatcgctgtaaagctctttgtccaaactgaaccacctggaatgttcatcaatgattcagcgataataatgtgccccgttgatgatactggcaagaattctgttaatccttccacaataccaattacaagagacttcaacaaatcaagcatatgctgctccttatttttaaatatcaacagtactactttaccaaaccaacctagaaacacctaatacctgagggacttctttactgattaattgaaaatagtatcaccgtctgtcgtcacaacgtttagacgatcagtcgctgattcatcgcgactgtaactaccaacaaagcggttgccttgaatcttaatgtcaccgttgttagcttgaatctgtaacccaggcacgggcatattcgttacatccaagttaccctcacgcaacgtccaggcattcacaccagtcaattgcgcattttggacggttagattaccagaattcaactgcacaaccccgtcattcatcacaacatctttcagttgcatatcagtgtcagacgctgaaacgaatgccttgccgagcgttgcttgcttggctgaaaattgtgaatcagccaggttcatcgttgtctcaggtgacttcacaccattaagtgttaccaaaccatacgtattattcaacgtcaaattcttcgtctcaacatcatgtagcgatgaagaacctgagtagtttcgaatatgcacgtatttcatcacggcctttttcggaacataaaccgtcaaaacgtgttcaacacgcttattaaagccaacccggtacttatctttttgcgtcccagtataacgaatgtgcaaggcgccatccttgtctgtgaggttaagctgcgtggcatccccaacagttcccttcacacgatactcattcttatcactcgcaacaacgtgaacatctaattcaaccgccgtcgcatcaatcgttttgatggtatcgaatttttgattgattgctttttcctgtggcaacacaaaatgaccatcacgccaaaccaaactattttggccaccattgacgtaaccaatcactgacaacatgatacccagtgcagcgacagcaaagccgataatgataactcgtagcatcttaggcatgcttcacacctccttgtggcttgcgagtaaagcgacggccgataaacttaacaaagttcatcaaggcacggaacaccgttcgaacaaccacgaagccaattggccatgcgataaattgcagaccaatccaaatcaagcctaagcctccttggaagaaggcagtttgccaactttgaccggcaatcgcaattgcaccaaagacttggaagaaaccagtaaagagcaaccagagcaaaataatgataactgctactgctaccaagacaacaccaaacaagcccagcaaaattgcaataattgctggaatccaaacaactgatgtcaccaatccaacgataaccacccacaataggtttagttgtcgctgaatacgtgacttgaattgcttcgttgcagaactaccttcgtctggtgcctcttgatcagcgacatcatcatagcggattgaataatccaccaagacacggcgggctaattgcttaggtgtcccaaactcagcgattaacttttcgccgctaagtccagcatccgctgcgtattctcgataaaatgcaaggacatcatctcgttcatcttctgtcagaccaaacaaatgtccgcgcagttgtgtgaagtaaatgttattctccattgtctcccctctccgccatcataatttcattaacattgccgctgaaagttcgccactcatcttggattcgcaccacttcagaacgtccttcatcggaaattttataatatcggcgattacgcccttcaaaaggttcatcgtatgtcgtcacccaacccttagacttgagacgacgtaagactggatacatcgttgattcggaaactgcaaaacgctcttgcacctgcttcgtcaacgcatagccatataaatcttcgtcagaaagcaacgccaatactaacccatccattaaatcactggataattgcatcgccataattcattttcctttacaatactataagtcatataatatactctcagtataagaaagaatgctaatgttgtaaaggcaaacaccatacaacaagttctaatggcatttaagaggggtatctattatggcaaagaagcaattaacaaagtctcgtgataaggtcatgagcggtgtccttggtggtttcgctgagtatttctcgattgacgcgacactactacgtattatcttcgcaacagccgctgtgttctttttcccactggttgttttgtatttcattgcagctgtggttatgcctgaaccatcaagccacaatcgctacgagtaccgtgataacgatgatcgcaaagacgtcacaccacaccgttacgacgacgacatttaatgcaaaataaagcgccggctaggaaacaatcctaaccggcgctttttatgtctatcttaccaactgaacaaaccaaccatagcagctgacatcaatgatactaagatacctgataccaagatcaacggtacatttgcagcaatcaaatcagccttttcacggttaaccaggctcttgtatgatccgataatcatccccaacgtaccgaagtttgcaaaactcgtgacgaagaccgtcaaaacggcacgcgcgtgagctgaggcaaacattcccgtgtggtgaataacatcctttgacacttctcccatgacaacgaactcgttcgttaccagttttgttcccatgtattgggcaatttggaaggcatcgttcacgttgaaacctagcaaccatgcaaatgggaacataatcacaccgaaaatattctccaatgacaaccatggcaacgtcgtcaatgacaacaagttatcaatcaacgcggccaaaccaacgaaggcaataaccgtcgcaacgataatcaccgcaaccaatccagcaccctggatagagtcacccaagaaagcaaagaatggttggcgttgtgtcttaccattatccaatgtctcttcgtggttcaatactgcgattatatcttcttcttcaggtacttcgaccggattcaaaatcgttgtcatcataattgcgctcaaaatgttcaacggaatcgccgtcaatacgtattgaccaggcatcatcccaacatatgaaccaacaatagccgccgtaactgtactcattgacatcatggcaaccgtcaaattacgcttggcattcatttgttgcaattgtagcttagaaacggccaaaacttccgtcgttcccaagaacatcatttcaactgagaagaatgactcaaactttggttgacccgtcaaaaatgacaagccacgaccaacccacttaaccaaccatggcaaaacaccaaggtatgtcaaaatatcaaacattggaatgattacaatgattggcaaaacggctgacgtcacgaagttcattgaacctgacgctggctttacccagtctggcaaggcaaatgaaattccgtcaaaggccgcactggtcaaccactggaaaccattagctgcagccaagacagcgtctcgaccaatcgtgaaactcgtgaagaaccatgccaacaataattggatgaccaaaattacaccaactgaacgccagtggatgtgcttgcgatcacgagaaaataaatatgccacccctaggaatacaaaaattccaaggatgttcatcaacaatagcatcgctactctccttgaggggtatttatgtgaaacaacttaacaaacttaagtgtatcaaaagtaagcgacttgttaaacggtttacccttggtaataatttggttaaacgtttaacttagaaaatccacaaaaaaacacacctacttttgcaagtagatgcgttttcataatctttattgcgcgtatgaataataactagaaccgtaagttccagaaccatcgtccaccgtgctaccatcttctgaagtcgtgtcagtcgtttcatcagaactatcatagacgtatgaagtcaaaccgttagctgcaagcgttgctgagctaacttcgccggcaaacattggtcccgtctttgctgctttcaagccaagtgacttacgcaaaacattcgttccacgttgcttttcactctgaggaatcaattctgatgaacctgaaaccaagttcacttcagtaccttgcaagtgatccgtcttaattgtcttcgctgcgctgatatactttgacgcaatcgtcaacatatcatcaaacgtcaaatctgtattcgttgaatcagaaatcgtgttcaagaactttgcgttaatcaacttagttggattgctcttagccttttccacaatagcttcaagcactagtcgttgacgtgcttgacgaccgtaatcaccttgtgggtcatcgtaacgcatacgtgagaacgcaagcgcagccgccccgttcattttgtggtacgtgtgggttacgccgtcctcgcctgtgtgcgtgtaggtagatgatccttccgtaaagctataaagatttccaggatcagcgtgagccgtatctggattatagtcaaaggtcaacggagactttacatcaataccgcccaactcattaacaatcttttccaacgcacccatgttaacaattgcatagtaatcaatcggtacgtttagccaatcttgaatagtcttaatcgtggtcttagcagaccccaattcataagccgcattcaatttttgagggaactgatcctcatagccaatcggagcgataactgagtcacgtggcaatgacatcactgtcaccttgtcttgcttaggattaaccgtcaccaacattagtgaatcagtacgtcccttatatgttcgacctagttctccagtatcagtccccaatagcaagattgagaagggctttccatcagccaaaacccccgaaacatcacgtgccttcttaacaccagcgctttggaaagcattatcaactgcattctttgtattcttataggctgtgccggctaccacaccaaccgccaaaactaagacagcgataactgataaaataatgtttcgcactaatttaaatttccgaccattccttgggcgctttggaccacggggaccacgaactttctttttatgtccgctagccatacgttccgcttcacgccgtgccgtacgtgattgtggctcattttccatgagcgactcctctcttcaatccagtagtatttaatactgattaataacaatttttataattctcaagatagcgcaaaaacggtatcttggacattatacaagccttcacctttaaaaaagcttatagtaacttatttattctataccaaaaaacaagcctagtcagcatttctcactaactaagcttgtttcataattaaacattaaactgccacgggtgccttaattgacttagccggcttataattctcaaccttaatatcgtccattgtgtaatcaaaaattgaggttacatctgggttcaatacaagcgttggtaactcagccatttcacgagaaagttgctcagtcacctggtcaacgtgatttgagtagatgtgtgcatcgccaaatgtgtgcacgaactcgcccgcttcaagccccgtttgtgcagccaccatgtgcaacaacagtgagtatgacgcaatattgaacggcacacccaagaagatgtcagctgaacgttggtaaagttgcaaactcaacttaccatctgccacgtagaattggaacaatgtgtggcacggtggcaatgcttgtgatgggacgtcttctgggttccaggcactaacaatcaaacgacgtgaatttgggttcgtcttaatctggttcactacatcatcaatttgatcaataaagccgccttgcaccttacgccagtgacgccattgcgcgccgtatacgtcacccaattcaccaaacttatccgcaaaagcatcatctgccaaaatgcggtcaacgaagagttggtgttgttcatcataggcagcctcgaactcctcgtctaccaacgcacgacgcccaaaatcagtcatatcaggtcccgtgaattcatcggattcaacccagttcttaaatgcccattcgtcccaaatgtgattgttgtgttccaacaagaaacgaatatttgtgttaccttgcaagaaccatagcaattcgctcttaatcaagccgaatggcacacgtttcgttgttagcaatggaaaaccttctgccatatcaaaatgcaattgacggccaaatactgagcgtgtacccgtacccgtgcgatcacccttcacattccccgtttccaacacttcacgtgccatatccaaatatgcttgttcattacgactcatgtcattatccccttagttgttttcagttacgtacttgtcaaaattaatcattgcgacatccgtggctgttagtggcacttgttggagtgcaacacccttagcttggattaatgatgtcgcgaactcatcattattgtagttacggatgtagttaatcttcttaataccagcttgtaacaaaaacttcgtgcagtgaacgcaaggaaaatctgtgacgtaaatctcagcaccatctgctgcaatccccatttttgctagttgcatcaaggcgttttgctctgcgtgaaccgcacggatgcagtgcccatcaacaattaaatccccaacttctgtacagtgtggcgtcccagtaaccgatccgttatacccactcgcaataatacgtccgtcttttacaactactgctccgacatgtaggcgcgtacaagtactgcgtgatgctaacatagccgcttgcatcataaagtaagccggccaaccaattcgttcgtctttcatcattattccccatcgatttattttcgttactcctataataaccgacaaaatcgaacgtttcaaatcttgatttttaagttcgtacgtgattttattccgttttcgcatgttaaacgaacagaacatcataaacacagtctgaaaatcagccagttacgaatgttcaaatttttaaccgtcccaaatgaccgtaagcccgaaaattacggctatcaacaaatcgatatcatttagaaaatggaatttttcacgcgcctaaactctctcgttaaaaagaagtgcataatattattttccgttgtgaatttacattttttatgataaaattgtaaatgaccttagtgtgtcataaaacacactcgtttacgcagcggtttcatttgtcgctggatgtgaggatagcctcacgaaaggagttcttatgcctgcagcattagcagaaattaagcaacaattagacgatcaccttggtgagccaattactttgattactcacgagagccgtcaccgtaacatcgagcacgaagccgttgtacgtgagacgttccgttcagtattcgtcctagacttgaagcaagaaggtaacgagttcgaccgtgcctcattcagttacacggatatcttgacggataacatcgagattactttcgcctaacaaacaagccccgattcgcatcagcggatcggggcttttcttttactcttcgattgtcatatcatcatccgttgttggtgcaacacgaacaacttcaaactcattgatgtaggcatccttgaaatcaagggccgtaatttcaaaatcaagtaccttgatggtatctcctgctgacgtatcagaattctcatccaagaagaatcccgtcaatgtcaccatgtcagagtcatcaaatgggcggatgtccgcatggaagtaacgttcaaaatcatacaacgtcatctttccagagaccttgtagtgcatgttaccagcgtcatcagcacctagcttttcaactaggtcatcagcaactgcatccatctcgtcacgaactgaaccgaacaattcctcgtagatatccttatcagtcacgatacccgacgtaccgccatattcgtccttcacaataacgattggcgtacgacgcgcaatcatcttttgcaaaacatcttgaattggcatattctcaggaaccgttggcatgtgacggataatcttacgaacagacaatgtgtcatcaatttgggcttggcgcatcaaatcatagttgaagacgtatcccaaaatcttatccttatcattgtcagccacaactgggaaacgagagtgcttcgtttcaaaataacgttgcaaggtatcatgcactgaatccgtaatatcaaccacgtccaattgcgtacgatcaatcatgatatcaactgctaccttatcattcatctcaaaggcacgttgcataaagacatagtccgcatcgtcaagctcaccactgcgagcggccgtacgagacaagcttaggatttcggcttctgaataaacctcatccccttcgttagcgggcttcatacccatcaaacgagtcacgccagtcgctgagacgttcaacaaccacacgaatggatagaagataacgtggaatagacgcaatggcgttgcgacgaacaaagcgaccttcactgggaagtcgatggccacattctttggcaccaactccgtaaagacaacttcaacatacgtcaaaaataccaaggcaataaccgatgcaatcacgccggcacttgcccctgtcatttccttcaagaagccaccttcaagcaataagtgggcaattgtctcttcacccatccaaccaagaatcaacccggccaacgtaataccaacttgggtcgttgatagatactcatttaggttttcaaccatgtggatagccgttgcaatttgacgtgatggcttttcacgttcttcttgcaactcaaccaaggcgctcttacgcaccttaaccaaggcaaattcagcagcaacgaacaacgttgcaaacaataggactaggatgatgacaataaccgaaattaataactcaccttcactcaatgttattccctactttcttttagtacaaattcaatgacaccattatagcaaaaaacacctgatatttatcaggtgttcactcgcgtatgattaatgttcgtcttctgagtcagattcaggatcctcttcaggcaacgccacaacttcgaaatcattgatgtaagcatccttgaaatccaaagctgtaatctcaaagttattaatcttgatagcttcaccaacttcaaagttaggatgctcatcaaggacataacctgtcaacgtgaccatttctgaatcctcaaatgaacggatttcagtcttaaagaatcgttcgaaatcgtacaacgtcatctttccagagaccttgtagtgcatgtttccttcttcatctgatccaatcttttgaaccaaatcatcagaaacatcatcgatttcgtcacgcaccgtaccaaacaactcttcataaacgtccttatcagtaacgatacctgacgttccaccatattcgtccttaacaacaacgattggtgcacggtgctcaatcatttcttgcaaaacttccgtaataggttggttttcagaaacgactggcaaattacgcaaaacagttcgaactgatgcatccatactcaaacgcccttggcggaccaagtcatatgagaagacgtatcccaaaatcttgtccttgtcgttgtcagcaaccactggcatacgtgagaacttttcttctaggtacaagttcaatgcatctccgattgtgtccgtaacatccacaactgttagttgtgtacggtcaatcataatatcaactgcaaccttgtcattcattgagaaggcacgcttcataaacgttaagtcttcttcgtccaactcacccgcttgggcagcatcctcagacaacgaaataatttcgttttgtgagtagatgtcttcatctgggtgagcattaaatccaagcacctttgttacaccagcagccgtacggtcaaacaaccaaattaatgggtaaagtacgatgtggaagaacataactggacgcacgatgaacaacaacaccttaaccggttggtcaatggcaatgttctttggcaccaagtcagtaaagacagcgtggataaatgtaaagatcaaaattgcggctactgacgcaacactgtgggcgatagctgctggcaatagatgtgatgaaataatcaagtcagcgatgaacgcttcacccaaccaacccaaaatcaatgatgtcagcgtaataccaacttgcgcagttgatagatactctgtcatgtggttagtcatgttaatggcgtgcgttaagtttgatgatggcttgttacgtgcttcttgcaacgcacgcaaagctgatggacgcaccttaactagtgagtactcagttagcgtgaacaaaacagccaacaacaaaataacaacaataacaacaatattgatcataatagacggaccggaatccataatcggtttacctcttctttaataaaaatattttcgtaataaacattataacagaattaagcgttgtacacacccgcatcatataatgcgttatgcaattcaatgaatcgctccaatgacaacttttcagcacgcgtacgtggatccaaatcgatagcttcaagtgcggccgtcaacttggcttgcattgcctcacccttaccaaaggcagtcgtcaagttgttccacaacgtcttacgacgcattacaaaaccaatcttgaacaactcaaacaattgcttttcgtcacgtggttgaaccgccaatggctcacgtggcgtcaatgaaataattgctgaatcaacattagggtttggcacaaatgctgttcgtgataccgtaaaggccaacttagcgttcattcggtattgcactgccaacgtcaaagaaccatagtcctttgtaccaggctcagctgacaaacggtcggcaacttccttttgcatcatcacgacaatgttgtcaaagtgaatacctgattgcaacacttgcatcaaaattggcgtcgtaatgtagtaaggcaagttggccaccaacttcaatggtgccgttgtatcagcaaattgcttggcgaattctttctccaaatcaaccttcaagatatcgttgtgcacaattgtgacattgtcatatggcgccattgtgtggtccaatactggaatcaaacggtcatcgatttcaaaagcgacgacttgcttggctgctcgggcaagttgctccgtcaacgcaccaataccaggtccaatttcaacaacgttatccgtatcctttacgtcaccggctgcgacgatattcttcaaaatattgatatccgtcaagaagttttgaccaagtgacttcttggtgttgataccaaattgattcatgatagcttgcgtgcgcaccggcgtcgcaatatcaggtacatcagacatttaattctcctcatccatctcttgtaagatggtctttaattcttcgtttgtcacgccaaacatgtttagtcgcttcagcaattgcttaccattaacgtagcccaatccaaggcgttctgagacatgttcacgtcgttgtgcagcatttgcaccagccatcagtccataacgcaccaaatcgctacgcgtgatgtctgacgtcatatcgacatcactggctgtataaactttgctaagtgcctggcgaatatcatccgccgaggcgtattcaattcctaaactatgatgcttaatctggcgaccagcttcatctttcgttagaaatgcgtgcttagcatctggcacgaccgccgtaataagcttccgcaatcgctcaccattgaagtccggatccgtaaacacaataatcccacgtgacttcgctgcacgctgaattgcttgtagcgtcgcttctgacaacgctgaaccattagtctcaattgtgtccgcttcaacagcatgacgcaaaacctcagtatcagccttaccttcaacgacaatcacttcctgaatcttcattacttatccaagtgccacaaacggtgtgcattcgccgttgtaatgtcagccaactcgttatatgtcatcccaagttggtcggcaatgttttgaatcgtgtagcggacgaacattggctcattttgcttaccacgcattggcgttggtgccaaataaggtgcatccgtctcaactagcaaacggtccaatggcactgacttcaatgtctcatggacatccttagcattcttgaacgttgcaattcctgagaatgaaatgtacatacccaaatccaagaattgcttagcttcttctgccgttcccgtaaatgagtgcatgacaccaccaaactcagcaacgttggcatcctttagcacttcatacgtgtcagccgtcgcttctcgcgtgtgaatcgtgactggcttgtggaattcacgagccaagtccaattgcgccttaaacaatgctttttggacgtctggcgttgggttctcttcccagtagtagtccaagcccatttcaccgataccaacaactgctgggtcagctaattgttcacgtagcgtggccatatcttctggcttaaagtcgccactctcacccggttgccaaccaacaatagcgtgaacaccttcaaattcgtgggcgatttcaatggcacgttgattaccaactgtgtcatatccaaccacattcatttcaacgacacgatattcacgtgcgcgggcccagtaagctgcgacgtcatgccaaaaagcttcgtcgttcaagtgcgtgtgtgtatcaaagctatccgctggacgctttgttggatcataaattgccatgatatctcctatttctaaacgtttgtaatacttactattttatcaaagaaacccagagaatacgaattgagacctgcaaaaaaggccaggatttaatcctgacctctcatcaattaatcttctgcatcagttgccagtacaagcgcctgtgctgacgtgacttcgttatacaattcattaatcaatgctgaactgaaacgatcatcacgacgtcgctcttgtatgaacgtcaattctgcactcaatgcccccaacaaaatttcctgctcctcagccgaagatacttgctggtctcgaatacggtcacgttcttgtgccgcgacatcacgtaatgcaactacataacgaggatcttcactttctgcctcagcctgtgcaatgaagtcagccaccgcaggctcgctaatctcagcaatttctgtaaagactagttcgcgacttgaatgatacttttgcacggcgtcatcagggtttaagtagcccgtcttcttaacagccttaaacttcttttgcatcgccaacgtttgattcaaatcatgttgttcgtgttcggtcagtcctcgtcgcgttgccttacgttgcaagcgatctatacgtcgttgcatcttctgattgatacgacgcatacgttcttcgggcttgagtcgccgtgaacgcatcaaactcgtcacaacgcgctccaaaatgcggaaccacatccgcacattgtttgacccacgtgcccagcgtgaatcagcattggccttcactctacgataataaatcatcgtttgttgcgatacgatgccggcatttatcgccgcttcaactgcctcatcggtaacgctttgaatatccgttaaggctttttgccaaatcgtgcgatctaattgatcaccaccatatcccaattgatcttgcaattgatcaatcacatttcgcttaaccgagttagacacatctaacccttccacatatgacatggccgcattaatcatagcgatatgcgcttctgaatattcgctagtgtcatactcaggcttaatttcaggcaacatccgtggcaagatcaacaacggtgccaccaaactgacgataataatggtcgccgcaatcagcaacaacatatcacggtgtggaaaggcctgaccattatcaagcgtcaacggcaatgagaagaccatcgccatcgttactgttccgtgaaccccacccaacgcgaaaatccaagcatcacggtttttatgggtttgatcgaccattgatgacatcggtgaatcctgacgaacacgctcaatcataatgtgacggaagactgccataacgccgtagattgcgaggccaattccgatataccctaaccacgtcgttaatggtgagtgaatataagtcttaaatacgcgaaccaacgaaataccaagtaacacaaacaccagtccatttaggagttgtgacacaatcatcgtcagctgattattcaagttatttaattgcgatgacataaactgcgtgtggtgcttttcttcattagagatgattcccatcaccaccacggcgataatacctgacacgcccgcatgttccgctagtccgtacaccagaataggtgacaagaaataaatcattacgtgagcaaccgtatcatcaaactgcgcgcgcaataaatgttggcgaatatacaaaagtaccacgccagcaataccaccgacaacagcaccaccaagggcaacaataagaaactcttcaaagccatgaatgaacgaaaacgtgccagtgttcatccacaataaagccaactccaatacaactagaccagtcgcatcattaaacaatgactctaaactcagtgcgcgtccgataccctttggcacttccaatccatctgtaacagattctagagcggttgcatctgttggcgttacgatggcagctagcgccaaagccattggtaaagcccagccaattgcccagtgaccaaacaacatcaagacaacaacagtcataacggcaacgataccggctaagttgataattgcccggaaattctttgacaccaaacggacatcagttcgttgaccttcataaaatagcaatggcgcaataatcagcatcataaaccattccggatcaagttcaacgactgacttgcttagcaccggaatcgtcgccaagataataccacctaaaatctgccaaaatgccttgggaattcgcggcattacctgtgacagtagattagcgacaacaattgtcaaaatcattggcaccaatgtgtaaaagattgtcatactatctttcctatctttttttaataggtctattctaacaaaaagagagcagtgtgacgtacacactgctctcttaatttttaatgattagcctagttctgaaccagcttcgatttcatctggcaaaatcgtcaagataacgttaccgtccttttcagcagacaacaacataccttctgacatttcacccatcatcttacgtggcttcaagttagcaacgaaggcaaccttcttaccaaccaaaccagcgtattctgggtaccacttcttgatacctgacaaaatcgtgcgaccatccttagtaccgtcgttcaacttgaagcgcaacaacttgtttgacttctcaacttcagtaacttcaagaatttcagctacacgcatctcaaccttgtcaaagtcatcaaattcaatcaaatcctttgtagggacttcaatgtatgacttttcagcttcttcagcaggctttgcagcaccacccgtcatctcatcgcggatgtaagccacttcggcatccacatcaacacgtgggaagattggctcacccttttcaacaaccttaccacccgttggtaggtcttcaaacttcaaatcagcgatttgcaagtttgattctgccaaaccaagttggtggaagatttgcttaggggcgcgcgtcaaagcaggttgcaacaagatagctgcaacacgcaatgcagcagccaagtgggccattacagaagccaacttatctgcttgtgcttcatccttagccaacgtccatggcgtcgtctcatcaatgtacttgttagcacgtgagatcaacttccaaacttcagccaaagcatctgccgtacgcaaaccagccatgttttcgttgtaagccttgataacatcgttagccgtttgaaccaaatcagcgtcaaattcagttgcacccgtgttaagcgcaggaatgacaccaccttcgtacttgttgatcattgcaacagtacggttcaacaagttacccaagtcgtttgccaagtcgtagttcaacttagaaacgaagtcttcaggtgtaaagataccgtcgttaccgtatggcattgcacgcaacaagtagtaacgcactgcatcgataccataacgatcagccaatgtgtcagggtaaacaacgttacccttagactttgacatcttaccatcacgcatcgtcaaccaaccgtgtcccaacacttgcttaggcaatggcaagcccaaggcgtgcaacataattggccagtaaatcgtgtggaaacgaacaatttccttacctaccaattgcacgtttgctggccagaacttatcgaacaaagtcgtatcatctgaaccgtatccaagcgccgtaatgtagtttgacaaggcatcaatccacacgtaaacaacgtgcttagggtcagataaaactggtacaccccacttgaacgccgtacgcgttacggccaagtcttcaagaccaggcttgatgaagttattaatcatctcgttcatacgagactcaggttggataaattctgggtgtgacttgtagtagtccaacaaccagtcagcgtactttcccatacggaagaagtatgactcttccttaaccaactcaacttcgtgaccagaaggtgccttaccaccgataacgttgccgttttcgtcgcggtaaacttcagccaattgtgactcagtaaagtactcttcgtcatcaactgaataccaaccttcgtactcacccttgtagatgtcatcttgatccaagaattgttggaagatcttttggatagccttctcgtgatattcgtccgtcgtacggatgaaaccgtcgttggtaatatccaagtctgcccacaacttcttgatatctgcagccatgccgtcaacgtattgttgtggcgtcatgtttagcttttcagccttttgctcaatcttcaaaccgtgttcgtcagttcccgtcaagaagtaaacatcttcattcaacaaacggtggtaacgcgcagccgcatcagccaacaccgttgtgtaagtgttaccgatgtgcaacttaccagatggatagtaaattggcgtcgtaatgtagaatgtgttcttatctgccatttttcttatacctcccgccactacgaatgggtagggcgtcattttttgattgcgagaccatcccgcaatgtctgttgtttattataacaaagtttaggaagccccgcttaagttatattgcggactttgaccgtaacttgcacaaaaaaaccgtaccatttctggtacggtttacgttgcatcgcgacgtcctatcctcgcaggaagcgatcctccaactactttcggcgctattgagcttaacttctgtgttcaagaacgcccttggttgtgcatctcgacaagagattgcttaaattctggtgaatatcgaatcatataaaaaatgctcctctactattagtttacagggcagagaaaaatctgtccgtaaatctagcataagagcactgacgggcgccgaacttgccaaagacaaatcgtggcatgccgtcactgatgtcttgcacgtactgaccattaatctcaatgatatacatcaccgtccacctctttattctttatcacatcaattttacgcgtcatccccaaaacgtgctggtttccagctcacacaaaagcgtcgctagtccccgaactaacgacgctttcttgattaattcaaactcccagttacagcctgaccacgcttgataacacgtggcgcgtccgttaacacagccaagtcttgcaaaggatcacggtccaaaatcaacatgtccgcatccttgcctggcaccagttcaccaacgcgttccgcaatacccaacaactctgccccgcgaatcgttgatgcaagcaacacttgttccagcgtcatccccacgctcgccaacaagcgaatttccacaccaggtccagacttgaaatcgttataacttgtaccagcatccgtccccatcacaacattcacgccagccgcagctgcgtcacgaatgctttgttgatgcgcctcccatagtgctgacgccttatcgtacatataagctggaatatcatccttgtgttgcaacatctgccaaggtgcagccattgttggtacgattgctgtgttcgtatccaacaacatttgaatggtctcgtcatctaaatacaccgcgtgctcgacagaatcaacaccggccaggatggcattcttgatgccctgcgttccttgcgcgtgggccatcgctggcttgcccttgtggtgtgcctcaagtactgctgccgtcaactcttccactgatagttgttcatccgttggttgctcaccatccaagctcacgccaccggtcgccattagcttaatcgtttgcgccccgtgcttaagattccaacgggctgccttgcgcacttcatcaacaccatcaacttccataccaatctttgaaccatgaccaccagtcatcgtcaacgctgcaccactaccgatgatgtctggcaattgtaggcgttgctgacgaatcttggtcgccaacttcaaatcgatattatccgttgagccagcgtcacgaatggttgtcaccccactcgcaatcgcatcctgcaaattctgcaacgcaaccagcgtatccaacgtgacatcctgacccgcgcgttcgcgaccgtcagctgccattacaatatgcgtatgcgcattaatcaatcccggcaccaaatacttgccttgcacatcaaccatttgatcagcctcacgtacggtctcaaccacctgaccagataccgtgtccactgacaccgtttgtgacttgaacccctcgttcgtcacatacacatttccaccaacataattaacaattgtcatataattaccccacgcttttatttcttaactgcttttgtaaagtcgaacgttgcgccgactgtattaatctgcaccccggttaccttagggttaatcatcactgaattcgttacatcgaataacgtcgtagctggcacttgcgtttgataaatcttctcggcacgtcccaggtcagccatgcgagcttcgttgtccatcacgtctgttgtttgggctgccgtcaacgcagcgtcatagttctcatcagtccagttaccaaagttggctgttgcccccgtttgccaattagccaagaacgctagtggatcggcgtaatcaccattccagcccaccaaaaccatttcgaattgtgatgacaacatggccttcacacgagctgttttcggttgcgtctttaccgtcacttgcaaacctggtaagtgactttctagttgtgactgcaagaattgggcttgattctttgatgaatcatcattgtcagccaacaaagtcagtgacgtcttcttgagtccttcttgtttcattgctttttgccaaaggcgcttagcttcctttgtgttgtaacccgtgttcttaaccgcattcgccttcgcaaaatcagtctttgtcttcgggtccgtcacaatgccaaccggcgtaaatgttttgctcatcgtcgctgaatcagacatcacattcttcaccatcgcggccttgttgatagcacgttgcatggcttggcgggccgtttggttagacaaaatgcccgtcttcacgttgaaggccaagtattgcgtccgcgcttgcttgatttggtgataaccggtcttacccttcacgcccttgatttgggttgctgacagctccgtgtaatcgaccttgttcgattggtacaagttgtaacccgttgatgagtcagtcaccgtttggaagtgaacttccttaggcttcacctgcttggcatcgatgtagtatttgttcttgaccaagcggtatgacttgttcgaaccattccaacccacgaccttgaaaggaccgttatagagggtgtcggttgacgttgacccgtacttgtcacccaccttggcttcgaaagcttggttttgtgggtaaaagcccttttccgttagaatcttggccatcatcggttcgggtgccaccaaggtaatctgcaacgtcttatcatctagtgccttgatacccaacgctgacaaatcagtttgctcacctgtattaagtgccttggcgttttcgatgttgtacatcaagttggctgatgttgacgcgttcttcgggtcaatcgtgcgttgccaaccgtaaacgtaatcttgcgccgtcacagggtcgccgtttgaccacttcaagttatcccgcaaggtaatggtccaagtcttgccatcttcagaaacgtcaaccttcttagcatccgccagctttggctcgttgttcttgccagagcgatacaagccttgccccgactggtcaataatttgtgatgaggcgacatctggcgcacgagatggatcaagtgtgctcaagtcagccgattgcgtccagttaataatattgtctgatgctgcaacatcccccgctggtgtaaccatccatccaagcgttgccgttgcaagtgtcatcaatgctagtgtctttgtgttcatgttcgtaactcctcatggtttggcgagttactaaagcgctttagtcaaaataaaaaacgaccagtatccatccggaagatactagtcgttactcgtgtgtaatatcgaataatccactagccttcacctatcgcggtgaaagctagcttgcttaaaagccatcattcaccgcttcttaaaaaagaaaaacgcgaatgacgtaaaggcattaactgaatatgctgttgtttgtactgaattgttcatgataatgcctcctgctttatttgatgtgttaagaatagcgaacccaaatgataatgtcaacactattttctaatttaattttaattaaacgtttaacggcaaacaaaaatgccactaggtgggaaactagtggcattttcggatctagccgattgggaggtcggcgatctatttgttatttttaaggagtaggattgtctgcgatgggattcacagacaaggagtatgagatatgttgattgctatgctatgggtttcttgtcttaagggttatcccctttcgacatgattaataatatagccggaaccttaactcagaaataactgtggctgaaagttagcttaattttgggtattgtccaaattgcttctcaactcggttgcaaacaaaaacaccactagctgggatactagtggcgttttcggatctagctgattgggcaatcagcgatctgttcgttatttatataaggagtaggagtgttttaagatattaagcttaaaacgggagtatgttttcattgctatgggtttcgcgtcttaagggttatcccctttcgacatgattaataataaggccggaaccttaaaggagtaataacgattcctgaaacatagcttaaattccgattttctgttttaaacaacagaaaacgccaccggacgggcaatccagtggcgtttgaaatcagcagatgggcgtccgctaattgtttaggagtagggttcgattgaggtgggcctcaatcagcatgagtagttatttgctatgggtatgttgaggagtcccccctctcaacacatatttattaaggtgccaaacttaaacgaggtataagattgaccgcttttatcgccaaaattttttcacctagttaaatcacacgctaggcggttgctgccccaacttgttctgggtacacaccgccattttcgtcacggcgttcaaacaatgctgttagcgccgtcttaagataggtttcatccccatcgttcaccgcacgccaagtcgccataccaccgcttgatttcatgacaatgtgaccagtatcttcgtaaacgtcatgatgggcttcgatgaaataatcaaacgccatcacgtctgcgtcttcataacgcttaattacagttaccatcttgagcccctctcttaagtttcactttcataaagtaaattataccgtttttaccccacttctgcctagttttacacccaatacgaaaagaaccggcctatgcagaccggtccattttcaaaattatgcaaccaattcttccgtcgtggtctcaatcacattggcacctaatggcttgccgtaaatcggcacaccggccgcatcaaccaagaaatcaaacgatgctaactccgtcatagcagccttaacgcgttcaggcgtcaaatcaggatcgatgttcaccatcttcaaatgcaccttcgcacccgcaatcttcgcaaacttcccttcaaataccaaatccaacttcttcatcttcgctacctccgattattctgccaagcctgcatcatacgcattcacttccgtcgccgaaattgacacgatttccgtttcaacaccaaggttcacgataacctgaccaagttgacgcagttgatcatccgttgtgcccacctttacgttgaacatgcggacgtattcagctcccgtctctgctgccttcgtcacataccgtaccttcatttgtcccgtcatttcgtcattcctccaaattcatttaggtggccacctgtttttgtcgacacctatactaacgaaataagtgagccgttttgtcgcatagaaaaaggacgactttttcaagccgtccaattatggttattgccatgtcccgattgtgtccaaaacaccatcatggttattatccgaaaccgttggtgggaactcatccaacaacggctgcgctgcattggtcatcgcaaatgggtggccaactagacgtagcatctcgatgtcgttacccccatccccaaacgctgccatctctgctggttcgataccataataggcaccaagttcctgcaggccgactgccttgttgatgtttggcgccacgatatcaatcatgccgaagcctgacgtggtcacgtgcgcggttccagccaactcacggtttagctgcgccatgaaggtctccgcatgtacttccggccagttcacaatgattttcacgaccggctcagtaatttcgtccaagctgtcaatgaaaatcaagttcggaaactcagcgaccatgtggtgataaagttccccttggcccttatcagcacgtagcatgtacccattagttgcggtgctataaacatttccgtggcccggtgacagcggtgactcagccaccgccttcatcgcgatttccatatgttcgcgtgacaaactgtgcaacgccagttccttgttatccttcgtgatgacttggccaccattttgtacaacgtaatcaaatcgtcccacaaacggtgccaaaaagcggtccaccgttgcgcgatcattacccgtcgctgccacaaaatggtaatcgcgctcatccaagtaatccagtagcttcgtaaatttgtgtgcattcacttgttggtgcttatcaaagaaagtcccatccaagtcaactgcaattagttttggaaatgccatcaaaagtcccccagtctttccgtgctttcctcgactccctcggtactagtatgacaagaatgtttgaatgatacaagaaagggatacgccgaattggcatatcccttaatcattaacccacgaagacgttctttcccaaactcaacatgtgtaggtattcttctgattcagttccgataatgaacgctgcgtttcctgacaagatagtcaacttgccttcttctgaacgttggtaaacgcgatcaaagagttgttcttgtagcttaggctttgaaccagccaattgctcaaggttttcaacaaccaatacttcgtaaccgtcgtatgtgtccttgaacttttgtgtaccaacttggccaccacgcaaaccatcttggaagtcctcgataaattgttcaacgccagtcacgtgaacttgggcgtccaacgcttccttaatcatgcgctcacgcatctcgtagctttcaccacggaccaaaatcatgttcaagtggtcagtgccagccaccgctgccgctgcgcgcttaatttgacctggcacatcgtggatatcaacatcttctgtcttcatttcaagcaagctagacaaggcttcgatttgttggttcaaaccagccacctgggccttcaagttcaaaataacttgctcaatcgcttcttggtgtgcaacatcaaccataatcatttcctccgtagtcacgttcttttgtacttacattttaccatgtaagcgcttgtttcttcagaattaagcacccttggctaaagtgggctataatagctttactaactaaaaatcagacggatggtaaccgcatgacttacacctacctttatgaacgtgagcccttgttcaccgataatgatatcgatggttttcttggagctgtcgagttggatgctgatattcgcgacatccccttcgacttggagaaaacgcaacaattaattcgtgatctgactgcccaattgtcagatgaaacacccactgcgattggattctttgccacctacccaacgtatggccactatgatgccttgggtcgtgaaattgacgtcacgctagaaatctcggtttcgcgctaagacaccagccaccctttttgccaccgtaatttgtataatgaaggcaacaattaggtagaaaggtggtccacgactatgggacttttcggaaacaaagatttctcactgccaatgacggttggtgatattccagccggatttgaagcgattcaaatcgtcacatcaattgctatgtcacccactggcgcattagctgatttggccaaggaagctgacaaacttggcgctgatgaagtattaaacgttcgcttgatgggcgatgaaaattacaccgcttacggcgatgcagttaagaagaattagtgatttgtacacctcaatcttggggtgtatttttttatacatacatgcggttatcacgtgcgcgccagttaccgttggcagcactcaccccgattttcttagccaagccagcccagaaacgaatgtctgacaatgacgcagcccccaacacgctagcctccgcatcataaaaatcactcatatccagtccgtgatcgcgaataattggcaacacaaaatcacgttgcatcgtcttaaacgccaacaccggaatcaaaccacttgcgactttggcatcaaattcattaaacgcgtcatatctaatatcttcgatttccccttctaacatagatgacaatcgtccgtgccaaatacgatattcagtctgcttatctgccatatgcatctacctctttgtgattaagttaaacttaatatagcacggttagaccctactttcaaatatgacataatgcatcattctacattttcataaaatcgtcacggaaatttggtatcctggttacaaacaaagaaatacggggaatttttaatgcttactgaataccaattgattgctgaacttgctcaaatcgctgaagctagtgaaaaggttggccaacgcacgcgcaacatttacttgggtgctggttggttcaacgaagaacaacaaaacatcttgatgcaaggttaccaagcattgaaggccaaccctacgattaacgatatctacgtgccattgttgaactaatacggtggtcaagttatcgaagcagacggtgattttgagcctgacttcgaatggggaacgatgacgtacaaggctgacatcacggcaatgaacaacgctgacttgattgttgccttcattgacgctgcagaccctgattcaggaacagccttcgaaatcggctacatgacagcttcaaacaagcctgccatcttggtaacggttggtgatcgtaacgtgcacccagttaacttgatgttgtcatacggtgccgtttcaaacgttgatttggaaactgaaggctttgaagctttggaaaagttcgacttcacgaacatcgcaatgaagaagtgggttggatcaatcttgtaagaacacgaaaaaaccagaggacacacgttcctctggtttttactttgccaacgcaattgacacccaaactttttcgtcatcaatgtccggattcacttccgcctgcaacttgacgccaccatccatccagcgcgccaaaattttgttgttattcttaggcaaataccctagctttgtacctttatacaaaactaaaatggcattttcatcatgcgcatttgttggatcacgaaccaagtcaacttgtggtgctgcatcatccacaatgccatcttcaactaggccatcgtaaatcgatcgctctttgtaagttagatacgcatagccaaccaccggtagcgtacgcaaatgaactgcgtcttcatagataacctcgattggcttgtagataatattacctagctcaatatcaaatcttgccaaccacagttccaaccactttttaaagtgggcatacccttcttgctcgtcactaccacgcatgttgtgactcttgtccccatcatgaatcatcacgcgccaccaagtttcggcctcaaatgcccatggcactgaatgccactcagcaacattagccggcaaataaacgtagttgataaagtctaaatactgttctgcggtcaaaacgaccgtacgctcactgttcggcccatcgaatcgtagtacaccttcgccaagcaccgttctgaacaaactaattgccgtttcagacccatactcattgaaggtaatgtcgattccttgaatcgtcgaattaatttctgtctcaagtctcatatcagcacccccgaatactgctattttcgcaatcataccatggaacggctgattgctgtagttctttgcttgcagtgcaaaatcaggttatactgagtttgtcaggcacatcctaaccggatgtccgacactacgaataaactatttacccgtgattactttgtagagtttgtgcacgggttttagtttacccaaatttttacatgaaaaaaggcggctaccttgcgcgtttaggtagccgccttttaagtgtcgtagatgtctcaataaaatgtttttattgtcatttactccacagcattttgaatacttatattataccttatccaccgtcaaaaaaacatgaacatttttagaactaggccttaatcaagcgacggtaaatcacaaccgtcaagaaataatacgccaagtacaagaccaaaatgccgattagtgatggcacgaagccaacgtatggatcactcaagattgccttgaacatattcaatccaaatacaacgtcaagcagtccgatgattaatggaataaagaacaaggttcccaagtccttcgcaaccgtcattgtcacttgacgttcgcttgttccaatcatcgttagaatacggtaacgacgcttatcatcagcaacaccagacaacaccttgaacatcaaagttgatgccaacattgctaagaaaccaattcccaagaaaattcccataaactcaaagccgccaaagtaactctttgccaatgcatagaaaccgtatgatcctgacaacttttgcaccgttgaatccaaagccttcgcttcacgttcagcgttcttgaccaagaccgtttcgttttcgtgcaagtcagcgaccttcactagttcagctgacttaaccgttcccttctctgccaactcatccgcgttcttaagcaccaccgccttagaatcgaattgcacaccgttgatttggtttgccaacccaatcaaagtatccgttgttgcctcagggttttgaatcatctcattcccagacatccacttaacctttggcgtactgtttggtacaccatcataaatcatcgttgggatgtggtgcgcattaatctcatccccatcaaagtaaacaaccttatcagcacccttaacgtagtgataacttgcttgccacttaatgttcttcaagtccttcacatcagcgttcgttgtataagctgccgtgtaaggttggctagattgtgcttgttccggcaatgcacggtagaagccttgtccaactgacatcgctccaagtgccaaaccgaagatgactgacaacaccgtcaacaaacgttggtaatcaggcaaacggaacatcaattgtccattcaagaatgaacgcaacccacggctgttaaaacgtgaaccacgcaaggcgtacgtcaacatcttcaatgaacgactcacaaagaagaacgttcccaagacattgataatcaaaatcaagatgaaccctgtgatacccaagctcaacacgtttggcatcatggcataaccaccaatcaacaaggccaacccaatcaaaccaagtagtggatccaaaatcttgcgacgctttgattgcttaacttgcttgtcagccgtcaacaatgtcaacgtatcttggcgactcaaacgagcactgttgtaaaggccgttcaagaagaacaagaccacaaagaatgccaaggttaccaagatggcgtggaatgagaaacctgtccagtgagctagttgcaagcccagcaggtccattaagaattggccactgaatgacgtcaaagcaattccagcaacgattccgattaccgttgagataacacccaatgccagcgtctcttgcatcaacatcatcccgatttgcttgcgcttcgccccaagcattgacattaagccgtactcagcttgacgcaaacgcagcaagaagctgtttgcaaaattcaaataaacaaatgtaatcaatcctagtaggaattcaccgattgtaaacacaaggacgataatcccggtcgttgagttagccagcaagaactccttgttcaaggcaatcgcgctaaacatatagaagatggctgctgacaccattaggccaacaaatagtacgagatagtcacgccactttgagcggagtgacttcattgcaatagaaaacatggtcatccgcccccttattcaaagttacccaattcagacaaaacatagttgtagaaatcttcacgtgaacgatcatcgcgcgtcaacgtcttagtgatttgtccgtcagtcaagaatagaatgcgtgaagcgaatgatgctgagaacggatcgtgcgttaccatcacgattgaaatgtcacgttcgtcattaatcttcgttaggtagttcatcatctcgcgggcattttcagaatcaagcgcaccagttggttcgtctccaaaaatcaatgctggctcgtgaaccaaggcacgagcggccccgacacgttgttgttgtccacctgacaactcagctggatacttgttcaagaactcactgatgtgtagcaaatcggccaccttttggaccgctgccttgatttgggcaggcttcgtcttttgcaaagtcagtggcaacgcaatgttttcgctgaccgtcaaactttcaatcaaattatagctttggaagatgaatcccatatcgcgaccacggaagtttgcgatttcatcatctgtcatgtgcaaaatatctttgttgttaatcatgacttcaccagtggtaggcttcatcaacgtagaaagcacgttcaacaacgtcgactttcctgatcctgaaggccccatgatggccacgaactccccttgtggcaccgtcaaagacaaatccttaaggacgtgctggtctaccccggctgcactggtataagtcttgttcaacttgtttgcaatcaatactggttctgtcatgtttttaatccccaatctcatgtttcattcatgttacaaataatactatacaacgtacaatataagatgtcaaaacaatatgtcaatttcgataattttctccagtaaaaaaaacgtcgattgctcgacgcctccgtgacttttaaacttcaggcaacttcaattcttctgccttaatcaattgtgttttttggataaagatcaacttcatcaggaaggcagctgctagtggtacaaccacaaaggcaaccaacacgcggactgccagggcactaccagtagactctgtcatcgccgtcaaaggtccaatgaagccagccataccgaagccggctgagaaggccgttccttcaaccatcatcaatgaagccactccacccgagatagctgatgcaatcacaacgggcaaaaatagctttggtcgtgacaacaagtttgccatttgaatcttaggtgagcccatgaagtgcgcaattgtggcaccccatgagttaactgaggcacccatcaccgccaacgttaatccagctgcgacgatacccgcgttagcagcacctgaaccgatacccaccaagccaatggctgttgcgataccaactgaagacattggtgacacaatcaacaaggcgaaaatgacaccgagtaagatacccatcaccaatggtgcagctgctgtagccgaggcgacaacttgaccaacggccgcttggactgcaaccatacctggcaacgtcatcaatccgataccaccagcaacaaccaagacgattaatggctcaaataccacacgcaattggccaagcaccttagttgcccccatcgcaaccaaccctgccacggccgttgtcagcatcacgttcaagattacccctgaaccagccaatgtgaaggtgccatccttaaacgttgttacgcccgaaccagccaacgtagccaaggccattgacgccgtctccatcatacccaacttcaacatcgttcctacagcaaacgctgcaatcaacggcaacggactttgcgccaacgtgaccatcatcgccaatgatgtgactaccccattttgtggcatggcacccaacaattgattcaccaacgcagctggtaccaaagcaaccataattgccaacgcattaccgttcaaaacggcaagcatgtactgtttcacattattcataagcatccccatccttattcactgacttcttgcacttgttgcatgtaattttgaatacgcgccatcgcttcttgtaattgcgcgtcgcttgttgcatagctcaaacggatataaccttccccaccaggtccaaaaacagaacctggaatcactgcgaccgctgcgttttcagccaaggccaacgcaaattcacgatcgtttgtgttatgcgtttctggaataccagcgtagacataaaaggcaccatctgggttcatcaccttaaagccagcacgacgcatttgtgcaaccacataatcacgacgcttgcgataagctgacttcatttccaacgttgcgcgacgtccagcttcggttcccaacgcgaccgttgcagcggccatcgctgggttagatggtgtcgtcactgtcatttggtgcaccattcccactgtgcgcatcaactcagccggtccagcgataaagccgatacggtaaccagtcatcgcgtgtgactttgacacgccgttcaagaccaacgtttgttctggcaagtacgtggcaattgagcggtgctcactgtcataagccaactctgaataaatttcatcagcaattacgataatgtcagtgtcagccaaaacggcagccaactcaagcaattgcttagatgagtaagccaccccagttgggttgccaggatagtttagaataattgccttaatcgcatccccgtgttcagcaattgcagctgacaacatcttgggtgtcaaaacgaagtccgtggcacttgtatccaagtgaactggctcaccaccgttcatcaatgtgattgggtcatacaatgggaacgttggtgttggaatcaaaaccttatcacccgggttcaagacggctgtcaatgaagcatagatggcttcggttgccccaaccgtcacggcgatttctgtcattggatcatattgcaaatcgtagcgatctgacaagaaatgcgctgctgcttggcgaacagccaccgtaccattacctggtgcgtaatgtgaatcattgttggcgatactatcaatcgctgcttgcttcacgacctcaggtgtatcaaaatcaggctcccccaatgtcaatttgatgatgtcaggaatttgactaacttgcatatcaaatgcacgaatttcattaggttgaatcttcttcaaatcttgattcaagcgatttgctagtgttgctttcatgtgtggcataaccgaactccttaaaataaaaaactgggcgatttcatttcgaaaccacccagtaatctcataacctcttgttgtcctaacaattcaggttgtgtatttggtcctgggaagtttaccgctatccgagaaccatgcaaaaatgcttttggtttgattcggatagctatccaaaaaaccaaaagtaatatgagtttgcaattgttgtctttgcattaatcatcatttttgcttccccttacttgttattgtttatttttctaatgtatttctaatctaagtcaatgaagaatttaatttaagatgtgaacggtgtgtgaagaacggagatagtcccaagccctcatgcctcgacgcaacgcgtcgacacaaaccacaaaactgcattaaaaaacgcgccgtatatctacggcgcgctgtacaactggttgtacaagatagtcattagcgtaactaccacggggaataactatagtatatagaccccctttttattttgctaataatatgtctcgaaaccaggatttaatttttagatgtgcaatgccaaggcaatcaaagccaacaatgctggcaaaccttgtaccaagataatcttgcgtgcagccgtcaaactaccgtacacagctacaatcacaatgtaagccatctccaacttcaacatgatgtcttgtgctgatccgtgaataacaaccaacgtcaacaaaatcaacacaccaaacataccattgtaaattccttggttacccaacaatgagcgtacctcaggcatcttcgtgatgttttcgtctatttcaaatgtctcggcttgctttgctggcttgccaaacatttccaatcccataatgtacaaggcttcaagagcgacaagtaccgtcaaaatcgttcctaccatcgtatatatctcccaataaatctaatccacataaatctcactagttcattagtctaacatgttgtaagaaaaaataaaaacgcagtgccccatatgtgagacactgcgttcattatattaaagatttacaccgttagatgcgatgacttgcttgtaccagtcgaatgacttcttctttgagcggttgaacgttcctgatccgtcgttgttcttatcaacgtaaatcataccgtagcgcttcgtcatttgacctgttgaagcagcaaccaagtcgataacaccccaggcgatgaagcccattagtggcacaccgtcttcaattccatcggccatggccttgatgtgatcgcggaagtagtcgatgcggtaatcatcgttgattgaaccgtcagcttcaaccacgtcttccgcacccaaaccgttttcaaccaagaacaatggcttttggtagcggtcgtacaattggttcatcgtaatacgcaatccaagtgggtcgattacccaaccccacttgcttgttggcaagtatgggttcttggctgacttaacaacgtttccttcgttcgctaccaactcatccaagttgtgcgctgatgtacgtgatgcgtagtaactgaatgacacgaaatcaaccgtgttcttcaagatttcttcgtcaccctcggccatttcgatagcgtcaacacccttagacttcaacaaactcttcatgtatgaagggtagtaaccacgcgcttgcacgtcaatgaagaacgtgttgtcgtgatcatcaagcattgattgccaaacatcttctggcttacttgtgtatgggtagaagcttccgccggcaatcatgcaaccaacttgtgcttctggcaacatttcgtgaatcatcttaaccgtcaacgcactagcaaccaacacgtggtgggcagcttggtacgtcacttgcttttggttttcaccctcttggaaggccaacccagcaccagagaatgggctgtgcaagataatgttgatttcattaaacgtgatccagtacttaaccaagtcaccgaactcttcgaaacatgtcttggcataacgcgtgaagaacgtaatcatgtcgcggctgcgccatgaaccgtaaccttctaccaagcccattggcacgtcgaagtgcgccaacgttaccaagacttccatcccgtgttcacggcaagtttcgaacaatgaacggtagtatgcaattccttcagcattaggtgtcgtttcgtcaccatttgggtacaaacggctccatgagattgatgtacggaagaccttcaatcccatttcggccaacatcgcaatgtcatccttgtagcgatggtaaaaatcgatacccgtgtggcttgggtagtaaagcgtctcatccaattcaggatgtgccacttgtcccaacttcactggcatacgcttttcgccgattggcaacatgtcaatgttacttgtgccacggccaccttcgtgccaagcaccttcagtttggttagctgcaattgcgccaccccacaaaaagttttctggaaatacattcttagtcatttaaccagttccccttaattctcttaatctctcgtttatgccaatgatgcgtcagctgcaatagccgtttgtgcatcgtcttccttctcgtggtggaagacttccatgacatgatccttaaatgaaacgttaccaggctctactggcgtaacgtccttaaattcgtctgtgttcgtaataacaacaaccgtcgtcgtaggcaaaccggcagccttgatagcgtccaagtcagcttgcaacaattcagttccaacttcaacgcggtcaccagcagcaaccaatgcttcgaatggctcaccatttagtgaaaccgtgtccaaaccaacgtgaatcaaaacttccataccgtgatcatcagtcaaaccgatagcgtgcttcgttgggaagaccgtcgtaaccgttccagcaattggtgaaacaaccttaccgtcaactggctcgattgccatacccttacctagcaagccctttgagaagacttcatcagcaacatcgtgcaagcccataacggcacccttcataggagccatcaacttaacgctagctggcgtaaccatatcagcttcatcttcttcaacaggaatgtcttcgaagccaagaatcaacgtcaatgcgaatgaaacaacaactgagattgccataactgctgcaatccacaaaatgcttgttgggttgtccttatcaataaattgaactgacgtgaacaaaccaggcgctgccattgagtgtgatgccaagccggccaaaccagccacggcacccgcgataaatccagtaataactgaagcaatcattggtcgcttcaaacgaattgccacaccgtacaaggctggctcagtgataccagcaatcaaagctgatgaagcagctgccaaggcagtttgacgcaattcgcggttcttcgtcttaaaggcaacggccaatgagacaccaccaagtgacatgttggcaccgatttcagaaggcataaccatagcttctgaaccagtctcagcaatcgtcgtcacaatcgttggcgtgaacacacggtgcattcccgtcataaccaacaaaggccagatagcaccaacaatcgcaacggccaaccaacctagcttaccgtggataccgtaaacaacagctgagataccgttacctagccaaacaccagcaggtccgacgattgagattgcgataaccgcaccaaccaacaagatcaacattggcttcaagaagttcttcgttacaagtggcgtgatgcgatcaacaccagcttcgatgtaacgtagcaaccatgacataacgatggctggaataattgtgtacgtgtacttaactgacgtgattggcaacattgccaacgttacggcttgcccttcagcagccttcgccatcaagtccatgaacactgggtgcaccatcaaaccagcgatggcaaccgccaagtacgtgttcgtaccaaacttctttgatgctgaaacagcaaccaagattggcaagaagaagaatgccgcatcaccaattgtgttcaacaaaacgtacgttgagtttgtttcacccacaacacccgtcattagcaacaacattgccaacaacttaaccattgatccaccgatgatggcaggaatcaaaggcgtcatcgttccgataatggcatccaaaatcgtcataccgacgcgcttcaacgtccacttttgctttggttgctcgctggcgtcgaccgtagccccaccatcaacaccaagtgccaaaatttccttgtaagcagcagccacgttgttaccaataatgatttggtattgaccaccttgcttaaccaatcccataacacctgggatgttctttacagtttcatcactagcctttgcttcatctttcaaaataaagcgcaaacgcgtcatgcagtgcgttagattagtaacgtttcctacgccgccgacagcatcaaccacgctgctagcaagcttcttaaaatcttgagccattagctttcacctcaaatatatccttaaacatctttattacttaattaatgttagcgtttacatttagtcaatttttgggctaattatgaccaaaatatgaaaccgcttactattgactaggacttatttctgtgctttcagtgaatttgcagagttgtgttatgtaactgtcatgaaaagattggtagtccgcggtcctcatgcctcgacgcaccgcgtcgacactaaccacaaacaatttacgacaaaaataaaagccatactgcgtatccgcaatatggctttaggttatggttgacgacccacaaaatatttttgattgtgaaagcgttgatgttgataaagagtcgtcgcatcaccctcttgctgctcgaattttctggagagaaattatatcgttctagtgttttctgaaggagaagagttttcagctagttttagatattgaacgatgttttcaagcagcaagagtgagatatgacggcgtgataccaactagggccccatcccttctacgcttttaattaatgtctaccaaatgttacgttcccccgtgtctttaacacatttattattgtaagcggtttcaaaagaaatgtaaaccctttcattgtattttcttttttcttttacgacaaaaaaccagcaaatctcgtaaaaacgagatttgctggttaagatgattatttcagtgagatttgatttgaaagtctaatttaatggtgtactattccatgttagagtgcgttgccttggccgtgtcgtttgagacgtggtcgcggcggctaatcatcaacgtcaagatatccaacgttacgtgaacactttgatcaaacaacgtgctcaacaattggattgacttcacaccgtccccagccttggttgcaccagggacgatgattgcggcttcacccaacgtagccaatggtgacgttgggttagacgttacaccgataacttgaacgccgttatcggctgccttttgggcaggtccaactactgaacccgtcgttcctgaaccagaaacggcaaccaagacatccccttcagctattgatggcgtaatcgtttcaccgatgacgaacaccgtgtaaccgatgtgcatcaaacgcattgcgaatccctttgccatcaagcctgaacggccggcacccaaaacaaagatacgcttgtccttcgtgacgatcttttcagccgcaaccaattggctttcgtcaacttgcgtcatcacttcttgaatttctgacaatacttcatttaccaaagacattacaaagcctccttaaattcacgcccggctgcaactggatcagctgcaccggcaatcttaccaccaacgattgcaatttctgcaataccgtcagctgacaacttcttcacttgatccaagtcaataccaccagcaaccgcaatgcgcttagcagccgggaattgctcgtggaagtgcttaactgaaccagcagcatcaaagtttgatgcgttatcgtgtgagtggtgcaagccaaagatagcgtgttcgaacgtcatcaatggcgcaatctcttcgtccgtcatgttcaacaagtcgatcaacatcgtcttgccagccttttcagtgacgtcataaacagcactgatagtagacaagtcagctgaacccattaccgtcaaaatatcggcattgacttcaaagcccttgttaaactcgtaaacaccttcgtcaatggccttcaagtccatcaacaattctgattgcttaatttctgccttgatatctgacaaagcaatcaaaccgtagtcctttaccaaagacgtacccaactcaatcacatcagcaatcccatcaaggtcctttgccaacgtgatagcgtgtgccaatgacacacgatcaattgcgacttgtaacttcattagtcttcactcactccttctgcttcataaaacgccttaagttttgcgggcgttggataaccatcattatcacctggcgtttgcacttgcaaagcacccactgcgttaccgcgcattgctgctgagcgcaatgacttgtcttccaacaaagccgtaatcacaccgagtgcgaacccatcgccggcaccaaccgtatcaaccacgttgttaaccttgaatcctggtaccatgaagccttctgcatcacgcgtttgaacgtatgcaccagcaggtccaaccttcacgatgacaaccttcgtacggtcactttggttcaaatagaagtctgcaatatccttagggtcttcactacccatcaaaatcttaccttcgttcatacctggcaaaataatgtcggctgacttagcaaactcgttaatctcacgaatcatgcgttcgtcatcattccatagtgctgggcgcaagttaggatcaaacgtaatcaacttgtcagctgctaccaaacggtccatcaagtgacggaacgcttggtttgaagtttctgacaaagctgggaagatacctgacatgtgggcgatcttcacatcgtccaacttaacgtcatccaacacatcagctgacaagtgagcagcagctgaacccgtacggtagttaaacgtttgtgggtcaccagtagttaccatttgcttcaattggaaaccagtccagttgtcagcatcttctgtgacgaaggtcgtcccaacaccgtgttccaaaatttgcttcttagcgtaaccacctagtggatcggcacccaaacggctaacgtattccgttgtgtgacccaaacgttgcaccccaatggcaacgttcagttctgccccacccaacaacttaaagtagttaatcgtgtcaaccaagctagcgtccgcgtccttagacataaacgttaccactggctcaccaatagttagaaattcactcatgattataatccctcattctctgacttaatgatcaaaacggccaaaataacgttgatgattgaaacaatccacattaccggcacaccttgcttcaacaattcacgactgtcgaccttcatgtacttcaaagcccaaacgttccatgattgcgtcaagtcagttgacacagccatcaaacttggcacgtacatcaaaggcaacaacaatgaatctgggaaaatgtgggcacctgccaaaacggcagctgtcgcagcaccagcaccccaaacgtgcaaaggtccacggaacaaggccaatggtgcagcaattcccaaggccaaggccaatacccagatgtttgaaggtagaattgacgtcaacaacgtttggaaacgcgcggcgttaatttgggcggcacctgagaacataatcaatgccatcaagaacatgatcaagccggcaatatcagaaatcgctgtttgaatcgtgtcattcaagaaatcaataaatgacttccagtgacgcatctttcccgtcaacaacatggcaagcaacgttgccaaaatcaatgatggtaccgcatcccacttaaaggccaagttcataaacactggtacaaccggcacaataaaggcaatccatggaatcttaacttcttcagttgattcctcagcaccgaccaattccaagttttcgttagccttagctgggtcaaatgacttgcggtgcaagaataggtaaatgataacagccaacaattgtaccgccatcgctgcaataccgaagaccaagtacttaccaccatattcagcctttgggaagaatgccttgatttggttgaaaagcaccaagttcaagtacattggcgcaccaaccgacatcaagaaagctggcaacgcaatcttacgaggaataccaagtgacaacataattggcaacaagataactccgatagcgataactgacccaacaccgtaagcactgatgaaaatcaatgccgtaaccaaaacaaccaaaatggctgccaacattacgttcttcttaccagccttcgcggtacgttgtgaaatggctggtgcgatacctgaatcaaccaagacgcgaccgaaccaagatccaaacgcaatgtagataatcgttggtccgtaattcaaagctggttcagcaaagaccttcttgattgccacatcaaatggtaccaagccaatcacggcccacaagatagccatcacgaagaaaccaaccatcaagtttccacccttaaatatgtagaagatgaaaccgacgaacgtcaacaacaatagaattgcaataatcgtattaaccatgattaacgtacctccatggcgcgacggagcatcgtgacttgtgcagcgatttgatcatccgtcatcattgggaattcaagtgcggcatcaacgtcagcatcaaatgcttgataaatcttttcccaatcgaatagtccttcagccaaatcgtccgtcacagtaagcccgttatcggtctcggctgcgttcttaaagtgaacgtaatctgtataaggtgccaacgtttcagcactcttaaccgcatcacccttcgtgaatgcccagttaccaaggtcataaacataaccaatgtttacgccggcttccttagcatcacgcaagaattcgtgaattggctctaggtgaccgcttagttcagtttgatcattttcaatattgatttgaatatcagcaggccatgcttggaacgctgcaaccaaatccccatcgaaatgtgcgtaatcacctagattaaactttgccttttgtgctcctagtgcttgaagctccgcaatatattgcggtagcttttcgtttaccgccccatttacaaatagctcatccggaatactcaacgccaaggccaactcgctagcttccgctgcatcacgtacagccgttagctcagttgccaaatccttgaagtattcgcgacgaacttcaataccgtccgcacctaagcgttcggcttgcgcaacaagatcagcttgtgcgcgtccttgcttaaccgcatcctcaaaaatccatgtgttcaaaaatagttttgccatgtcattcccctgtgaacaatcgcaccatttcgtcaaatagtttaattgatcagctcatccatcaatatcatgtgtctcttttttaggttaagcgcttaaccaccgtctaaaaatatatgggcgtgatgcccactggttcaagtcgctccctaatctcacccgtgggtaaaagttaggtaagcgcttaaccttatgtgaaaagaataacacccattacaggtgttgtaaaccacttattcatacgtcgccgcaatcaccactttttcagtgtgttgcattaccgtctttttatcgagtcgacgtagtagcaattcagctgctgtagcccccatcaaaaaggggttttgctggattaacttaacgtttggattcaaatcacgcgctagtttcgtgtctgaaaaaccggttacttgtcgttgttcatttaacacattctcacgaatcatgtgtggcaagatttcgagcatcaaccgttccttgaagaagaaaatcacggttggttcttccccacgcaattgttgcatcatttcatttaggacttcttcacccacaatacctgcgcgcggtacttcaaccatcgttgcgtttggatacaccgcttgtaccccacgccaacgtgccgtacgggttgaaacgctggcaattggttcagtcacaacaatcaaacgcgtaaagccatcatcatgatagtgctgggctgcacgcttagctgcttgttcattatccgtcaccaccatgtcgtagttaccacccattgtctcacggtcaacgagcacaactggcaagccctttttaatgtgcttttcgagcaaactatcatcatctgaaatcggctgaataatcacaccatcaaaattttgctggctcacgcgatcgagcaaagatgcttcacgggccactgatgaatttgtatcaaatagcacacctgtatattgttctgcttcaaggattgaagatgcacccttaaagaattctgttgaaaaatagtcgtcaacatccgcagccacgaccgcaatcaaaccactgcgttgcgtcatcaattgaacggctgacgcgttaggcacatagcccgtctcttcaatgatttgcttaatccgattcgctgttttgtcagacattttttctaaccgaccatgcaaatatctagacacagtcgcaatactgacaccagcgcgttctgcaatgtcattgatatttaatttctcttcatttgccattgaagaactctccatttcagattgtgttatatcaaagtatagcattttatagaattgtggcaaaatacacaaaaacagcgaaccgctaatgcagttcgctgtttttgttattatttcgcatattccactgaacgtgattcgcggataactgtgaccttgatgtggcctgggtaatccaaatcgtgttcaatttggttcttaatatcacgggccaaaaccgttgcttccaaatcagaaacagcagctggctcaacgataacacgaacctcacgacccgcttggatcgcgaatgacttttcaacaccactgaagtcatttgcaatggcttcaagttgttgtagtcgttgaacgtaattttcaagtgactctgaacgtgcgccaggtcgagcagctgaaattgaatcagcggctgcaaccaagacagcaataacagactcagcttccacgtcaccgtggtgtgaggcaatggcattaatcacaactggacgttccttgtacttcttggccaattctgcaccaagctctacgtgagaaccgtcaacttcatgatcaattgccttaccaatatcgtgtaataatcctgcgcgcttggcaagcgtaacgtcttcacctaactcagcagccaacatgcctgttagtttagcgacttcaattgagtgtacgagcacgttttgtccataactcgtacggtagttcatgcgaccgattgtcttaatcaagtcagggtgcatgttgtgaatgcccaaatcaaagattgtttgttcaccaacttcacggatgtgctcatccatttccttacgggccttttcaaccatctcttcaatgcgagctgggtgaatgcgaccgtcggcaatcaacttctccaaagcattcttcgcaatttcacgacgaaccggatcaaatccactcaatacgactgcttctggcgtatcatcgataatcaaatcaataccagtaactgtctcgatggcacgaatgtttcgaccttcacgaccgataattcgtcccttcatgtcatcgttaggtaacgtcacaactgataccgttgtttcggcaaccatgtctgcagcagaacgttggatggcgctaaccaccaagttcttagcccgcttttcagcttcggctgcagcttgctcttcgctttccttaatcataacggcacgttcagaaaccaaggcatccttcgtctctgacaagatttgctcacgagcgtcatcgcgactcaagtttgcaatctcaaccaactttgcttcgcgttctgtaatcaattcttcagcacgcttttgcttatcgttgacactttgtcgttggtgatcaagtttcgtttccttttccgaaatgacttcttcacgcttttgcaatgaagcatcctttcggtccaatacagattcacgacttaccagacgctcttcttgtgacttcacttccgcacggcggtcttgtagttcacgttcaatgcgttcttggtaacgttggctttcatctcgcgcttcgacgatggcagtctttttcatctgctcagcatcgttagcggcttgactcgtaatatctgatgcggtttggcgtgcaatggttagcgagtgattaatgcgagtcttcgcaacttgataaccaatcgcaacgccaattacgattgcgacaagcgacagcaggatgatcattgcaatgttcatcttgtatctcctgtctatagagttgactttcatgtcaaatcaatagtgtttttttgcgctttattaacacatgtttcattttaggcttttccacaacataagtcaatttataccggaattgctgtaggttacaaaaagcccgtcacatcaacctttcggggacatgacgggccatatgtttcacgttgtaatcatttgttaattttcgggtgcaaccacggcacgcaaagttaatgacaataccaaacgaatgatagtggcaacgatcggcgccacgaacaaccatggtgtgacgaagatgccaagaccggctgcaatcaagacaattagtagcacaacgacacttgtccaaagcaaaacctttgtgtcggctcctagcaaagcatcggtcgtatcccacaactttggcaagtcagtcatcgttcgaacatggacgtcagcaatcatatcgtccttgcccactgccaccgttagcattggcgttacgccctccggtacaacttggttcgtaatcaacattgactcaccgtcgttaaccaactcagcttgcttggctgccttttcctcaggcgtcaagtcagtcattggttctgatagcgtgcccattagcttagtcaattggcgcactgatccagatgtgtcggcagttgcaatgtaggtcgtgataccacgttcacggaagaaacggtcgataggcaatactgctttgctcaatgacgttccaaaggtcataacaccaacaacttgaatgctatcaaccacataactaaccgaattacctagttctttgtacgttgccaaaacatcttcatctaccgtgtaatcattggccaagacaaacgcagccgaaacaacggcaaagtgttcatttaagataacaccttggataccggcatttggaataagttccacttcacttgcgctagatggataaacaccgcgttcttcagcgaatgtcagaatattcttagaaagcacatcgttaactggttcaaccaagccagtcacaataccaagaatgtcaaaatcactgtaacgatcatccaaagacatgaccgaagtcaccgtcacatcatcgctagtcaacaagcctgacttttcaacaatggcatggtccacatcacgaacttcatcaagtgcgtgtggattttgaaatgtgacaccttccatagccagtgcacgcaaaatgcggaaacgacgccaaccagcccagaatgctggccaacgtggatcaacgactagcaagacagacgttgcgacagtcagacctgattgccagttcaacgttagtccgaagaagatcaatgcgtagatggctaatacaacaaccaaccacgtcagacgacgcgttgcttgcttcatcacatcatctagcgggatggctcgttcacgacgttgcaacaaaccaaacgttaatagcaaaatcgttaagccggccaacataactggcaacgtcatcgtctgcaagaagtcaccagcaactggctgcttgtaaatccaagcggtcgtcgccaaccaaagcgtttgaccgatgattggcacccacaaagtcgtcaatccctcttcttggcgttggcgccatgcttgcatccccatacgtacatcaaccacaatcacaaacacagtcgcaattgcaaaggctgccatcatgcgatgtggcactgacaagtccaaaaacggactcatgcccagtaacactggcattatcagcgccgtcaaaaccgtcaaaaccaccccaacaattgcatatctgagataacgaagctgtaatgttaacataattcatactcctcaagatttttgataaaaaaataaccgcgcccaatggacacggttatcagtaaggagaatgtgggattcgaacccacgcgccgctttcacgacctgacggttttcaagaccgttcccttcagccagacttgggtaattctccataaattgcgggagcaggatttgaacctacgaccttcgggttatgggcccgacgagctaccagactgctccatcccgcgataataaataaattgtcgacatccgagatgtcaaaggaggatgtgggattcgaacccacgcgccgctttcacgacctgacggttttcaagaccgttcccttcagccagacttgggtaatcctccaaaacatgtaagttacttatcgcaaccacatgtaatataatacgcatttgcctattaaatgtcaacacttttgttgaagcaatttaattttactttttcaactggcgcgttgcccagacattcgtcaagacagcacccaacatcaacaaggcaccaacccagtagatgttgtgcaaaccaaacgtcatgatgtcacgcaatggtgcaatgtgactagctggcaagttctttgctgtgtttggatcaatcaattgattcaactcagcgaagtgcaagttttggtgtgactgcaaagcaatcgacatagacacattaagcacaacaccatatacggttgtcatcattgtttgaaccatggcacgggccaagttattaaatgatgtggccatcccaatttgacttggttcaactgtttgttgggccatcaccgttgaggccgtaatcgttgaccccatcgtcaaaccgaaaattaatccagtggcaaggaacaacacgaatggcgcatcccctggcatcaccgccagcataatggcgtaaagcataccaacaaacaaactaaacttaaagagatattgcgcactgtgcttagccaagacacggccagcaatcacggcaccaaacatccaaacaactgaacttggcgtcacaacgaatccggcaactgatggcttcataccgccaagtgcttgcatccacgttggcaagtaaatgttgtaagcaatgatgaatccagccgtcaaaccagcaattgtgttggcagccgtgaaatcaacggacttaaacatcttcaaatcaatcaatggttccggtgccttacgctcgcgcttgataaacaagaccaaaccaagtactgaagcgacaaagaaaatcaccatcaacaaccagttcgcttctgaaatcatttgcaaaccaagcaacaagccaacgataaagactgacatccaaaggacacctgggtagtcaataattgcttggcgcttttcaaaggtatctttatagaagaaaattaaaatagcaattgtgataatgccaattggcaaattaataaagaatacccagtgccatgataagttttgaaccaaataaccacccactagtggtccgaccatcgaggcgacaccccaggcggttgagttcaagcccatgattgaggcgcgcttttcaattgggtaaaggtcggccaagatggtaaaggcaactggcatgataccaccggcaccgattccttgaatagcacgccagaaaatcaaagttcccatgctatccgacacaccactcatcattgaaccaatcaagaaaataatgagccctgatagcatagccggcttacgaccaatcaaatctgacaacttaccatagattggtgttgctacggcagtcatcaacatataaatactgaatacccagctcatcaacttgatgccgtgtaacgatccaatgattgttggcatagctgttgagataacggttccctcaatagctgacataaacgttgagagcaggatggccgccgtaatcaatccgacgtactttggctttgcttccattttgttcacctgctttcgttttattcgacttattattctaacatattgtaagctgcatagcgggttttaggtcccaaaataaaaaatcacgttaatttgactcatatttggcactttttagttaacggctcaaatttgcagcatactataatcattcagaagcgcagatatgcgccctgacttatccctagcataatttgaagatccccgactagctggttccccctcccccttagattcttttgccagctagccaaatcttcttaaaaaacacgcgtcccccctggcgcgtgttttttgttgcgtaaacccactaaaatgattgaaaaaccaaaaatcttcccacctcaggcacttttctaccgcagtcccctattaactggcataataaatcacgtgctaacccgtcactaatttctatcatctctctttccctttctcaatagagattagttgacacagcaccatggctttttagagagagccgtgtgggggttaaaaacaacttcatcaaaaaacggcggagcagatatgcttcgccgtttttgtttacttctttagttttagcgtcatggcattaatcgccacaataatagttgagagtgacatcagaatggcaccaaccattggatccagcttaaagccgaccggaatgagaatacctgccgccaatggaattgcaattaggttgtaccccgctccccaccaaaggttttgggtcatcttgcgttttgcttgacgcgctagttcaagcaacgtcgttacatcagcgagctttgaatccaccagcaccacatccgatgcattaatcgcgacatcagttccggcaccgattgccacacctaagtcagcttgcgccaatgcaggtgagtcattaacaccatcaccaatcatcatcaccgcaccattggcttggtacgtcttgaccaacgcaatcttgtcagccggcttcaggtcagcgcggacttcgtgaatacctaaggttgcagccacgcgttgggctgctttttcattatcaccagtcaacattaccggtgtgatattttgcgcctgtaagttggcgatgaatgcctttgcatctgacttaatcgcatctgacaagccgataataccaagtggttcatcatgcttcaacaagacactgaccgtctcgcctgttgccgtcgccttcacgattaggtctcgaacttgctgatcgagagtttcaggcaacgttgttggtgacaccaaacgatagtgcgcatcgccaatcataccagaaacaccttcaccagctgtcgccgtttgatgcatcaccattggcacgtccaattcatgggctgccttcaaaataccagttgccaacgggtgtgagctaccttgttcaagggctgctgcataacgcaacacatcatctgacgtccaaccgtcagccaaagtgttaacggtttgcaccttaaaatcaccttccgtcagcgttcctgtcttatccatcagcacgtaacgcaaatcattcacgcgttccaaggcagcgcggttttggattagcaaaccattttgggcagccaagcctgtcaaacgcgcaacaaccaatgggatggccaggccaagtgcgtgtggacaggcaataataaacaccgtcaccgcgattggcaaagcgtaagcaaagccgtggatggctgtccaaatcacaaaggccaaaataccaacaatcatcgcagcgtagaacaaccagccagccactcggtcagccagcgtctccgcgtgtgattgattttgttgggcattggcaaccaagtgctggacttgggccaagaacccatcatcagaacgatgcgccaccgtcatcgtgaatgaggccccaccatttagcgagccaccaacaacgtggtcgccttcgtgcttcatgacgccggttgattcacctgttagtagtgattcatccaacgttggcatccccgttaagacacgcccatcaactggcacacgttcattttctttgactagcaatacatcgcctaatgccaaatctgaaatcgcgacatccatgaagtggtcaccatgatgacgacggtgtgccatcttgggcaccaacgctgccagaccatcaacggcagaaccagccttcatcaccgcgttcatctcgatgatgtgaccaatcaacataatgtcgatcaacgttgccaactcccagaagaaatccatcaccatggcttcaggatgcaaggcgttcataatcgtggcgtacaaactgtaaacgtaagccaccacaatgcccattgtaatcaacgtcatcattgccggcttgcgactctgcagttcgccacgggcgccgttaaagaatggcgtaccaccgtagaaaaatagaattgaccccagcaacagtaccagccagttttgacccggaatgccggtaatcgtaaacggcatcttcatccccatcattggtgacagtaggataattggcaccgtcaagattaaggatacaatcagctttcgattcatattccccatatgcatcatgtggccaccgtgcatcatcatgtcatcatgattcatgtggtccatgtcatggatgcgccattggcatatccatgtccatatgtttttcgctcatattcatctgatgttcgctatgctcatgcatgctcatatcatgatgatgatcgtgttttgtcatcgctctcctccgtgtgtacaacttcacaattcattctaccgccaaactttaaataagcaaaattctattaaaaaacgttccggcatctgccagaacgtttctctttctctagttagccgcaagcactgcctgttgccgttcaacccgctttggatagtgcaccttgatacgcgccggcatccggactggctggagattaactactaatttattcgctgattccaactgcaatagcgcatccttttgcgcctgcgttagttcatcagcatattgttgtacattattgtgtaacataacggcacctgtaattttcattgcataagccgtcattgcggtataacaaaccttgggtactgacttcatgtagttctcaatcgttgtatcaagcgtctgtgcagctagcacattcatcatcatactgtgagaaccacgcaaatcgtaatacaagccgtttggcaacaaaataccttccaagcctgtttcaggcttgttagaacagtcattcgtcgccaaaaaacgactaactgacattggcggattggccgccatgtactctgaaactgcgacttgcacagacccgttttctttcaaccaattttcgatccgttgtgacttctccattgcgtccataagtgcacttcctttcgtagccggtggatacgttaagcgtacgcttatttcagtcaaatgttaaatgataacccttacatatacaaaaatgacgactagtcgttaaactagtcgtcattttcataatagttattatcccaagtgcttcaaaacaaacgtgttgtattggtcagctacaccagcaaggaatgacttcgttccttcgttagtgatctttccaccttcgtttgccaattcggccgtgttaccaatgtaaagctctggttggtgcatgatagccatgtccaagaagtccaaagagttacgcaacacgtggtgcgctacaacaccaccaagaccggcgattgattgtgaggcaggcaaaactggctttccagcccagacgttttgtccccatggacgtgaagcaatgtccaaagcgttcttcaatgcagctggcactgaacggttgtgttcaggcgttaccatgataaaggcatcttgtgcagaaacccacgcacggaagtcttcatattccttaggagagttagcatcaaggtcttggttgtacaaaggcaacgttgcgatgtcgaagtatgaaacttctgcatcggctggcaaaccagcaacaagggcctccgctacaccaagtgagtatgagttcttacgagttgatcctacaattacaccgtactttgtcatgattaaaatctcctaactgatttgtactacatttcacttacaatttataagtctatagtgtgtagcacgaaaaagcaaggtgtcaaatgaaaaggaacgtcccatttacggtccattttgacccgcaaatgtaggtaccttctgacttggtggcacaattatctaactttttgagaaaaccgcaaaaactttcacttctcattaatgacaaaacaaagtaatagcaatatgcttacagacatctcgaaattgttcgtttctgtcattcggttagataagaccagtttaaatttattaattcaccccacgaaaccacgaatcctttggctacatctaactcttgtcgtcgcctgatatctactaccctgtcggaaaaatctttctcaattattgttatgttaaggcccgttccgtccacgcatgatacaatcgtctaatagtggacatgtgtctattttatgaaaggaggtttatctatgaccatcgatcgtcgcattaaaaaaacacgggacgccttgtcagacgctctactttcattattaccaacaacgccgctaaacaaaattacgattaagtcaatcgtggacattgcgaatgtctctagaagcaccttttacgtccatttcgatgacgtattcgatttatacgaccaaaccgtcaatgagttactagccggcttggtaaatcaaataactgcggattatcccgatttgtccgaagacagtttttctctgttagtaagcaacttagttagttacatagatgatcacaaacacgcatttgttgttttaacgcaatcacaaaacactgatttattcggtcgaatgatacctatcttcattgaaaaaattttgttactagaacaccttgatcgtaataacccgactgattactacggtgtgacctactccgtaaccgggacaattggggtggttaatcaatggttgcaggatggtgcccaaacagataagcaagtcattatttcaatcttgacgacaatctttgaagaatactaaaacaaggctgggacagatacgtttgtcccagccttgtttttatcagtattgttttgcgtacaacatcgccgttaatgcaacatcttcgccgttaacgggtagcgaaatttgtttttctcctacccgttcaaagccacgcttgtcatagaattggtaagttgaaccatcatccgtgaataaatagatgtgtttgttctccaaatctttttctgccgcaattagcagttgtgttccgattcctcggccaacaatctctgtattgaccaaaaagaaattcaactcgccatcaacatgttgggtttgtttgtaatttgctaacatttcatcattggcactaccgtactgatctgacgtatccgcataaccacgttgcataatccactccatcaacgtaacgaatttttgagcccaccaactacgatatgctttctgttccccatcaatatctaacaaaagcacgccggcaaactcatccccttcataagctgcgtagattcgcgttgcacgtaacaactctaaataccaaaaatatttggcgtaaaaatataactcgaaacgatttgatgtgtactgtgacaaatgcatccccgtaatcgcaaatcgttgaatcttcccaaagtcttttcgctgcaatggcttaatttccatgactatccccccatttcaatttttaaaaacacttattccgctgttttaccctgcgtcaaactaataaccgctggcaacaccaaaggaattaagataactagcaataccaagccgacaatcacaacaagggcaacttgaattagcgttagaacacctgacggaatcaacgcggcaaaggttccgcccaaaataactgcggcagatataacaaccgtcccaatcatcgcaaccgacttgattaggctagcctttacccctacgcgggcatccttatgagctgctaattcgtcgcggtacttcaacatcaagaaaatggtgtaatcaacacccaatgctattaacatgatgaatgagaagaagggtgtattccaagtcaaactatcttggcctagcaaagacgacgtcacccagtgcacaatgttcaatgcggcatagtacgccaacactaacgtcccttcgatagcaattgactgccagaatgaacgtgtgacgaacaataacgcaattaagattcccatcagcatgatggccgctgttttaacaaagtctttcgttgctaaatcattcaaatctttggttgacgatgtcgtaccaccaattgcgaaggtagcatctttcaaatccgtaccagccaaagtggccgttaatacagctttgatattatcaatttgctttgtcgcatgtaccgtacttggatcacccttcaagtacactgtaattgacgtcatcttacgattatccgataggtatgtgtctaatgacgacttaaagccctcaccatgaatcatatcatttggtacgtaaaacatctctgatgatgatgactgcttgagctccttcacgtacttgttcacgtcattcgtgccggcactaacttcacctaggccaccatcagcgctagccaatccctctgacaatgtcttcatttgaccagcaaggccggtaaacccagccgcaaattgcgagttgccgttagcaacttgttgtgcgccggctgtcaattgtccagtttgcgaatcaacttcattcaacgccgtggtcaattgtgttgtccctgacttaagttgatccattccctctgataattgttgaatcacacttgccgacgttggtaacagctgatttgaggcttgcgtcaattgggcaaccgctgtttgtagttggctagttgtttcatttaatgatgttagctgacttgccaatgcttgatccgtagcgccaatttgctgtgcctgttcaccaatagccgtcaaagatgctgtcacttgtttctgcacagcagccatttcagcttgctgctttgccagtttgtcatcaatcgattgcttaacagcagcctgttgttcggccgtcatttcaatgcctgcttgcttcatttcatcaagcagtgactgcgcgtcaaagccgctgtcttcactcacgttttgcaacgcctcgttaacgctaccgagttgattgccaatctcgtttgccgctgaaccaatcttcgttaggtgatcagtcacatctgcgtcctgttgattattggtcagattaacttgttcatttaattggttaatcgcctggtttaattcaggcagagccgcggctaactgtgtaatctgttcgccatcggccgtccctgctgtcaactgactctacaatttattagtgcccgttgtaatctggccaatacctgattgcaacgatgctgcaccagcagcaacttcctttgacccatctgacaactctgtggctgatttcacagtaccactcatgtcagaaccatcaatttccgtcttcgctgaatgcaaaccagacttaatttgtgataagccatttgtggccgacccaagtccagaagtcacgtctgataattgttgcttaacgtatagcgctttgattttttcaccaactggttgggttacggacattactttttctacgctcttaattgacttaagattttgcgtaacttgatcaattacccgaaggtcatcttgattatctaatgttgtatttgactttaagtaaatcgtcgtcgaggcagccatccccttcgagaaatgagactgaagcaaattatatccttgcttcgatggcgtcttgtcactcacctcaaccgcactatcgtaatttaaatcaccgtgactttgtaatgcaatcggcaccaagataattagaagtgtcccgagtgcgattacaggacgtgccaaagccgttttggtaaggaattgccagaagcgactttcaccctcaacgttaaacgacttggttggccagaacataaacgaaccaaatgtcgtcataaagaatgggtttaacgttaacagcaccatcaacaagaccgccacactgatagcaataccaaatgccgacttataaaggtaaaagtcagcaaaatagagcgttcccataccaatcaacaccgatacgccggcgtacaaaatgatgcggccaccaactcgaatggcctcttttgatgccgcgaacttgtccagtccacgcacgagacctgatcggaactcattatatagcaaaatattataatcggttccaatcccaaaaaggacaataataataaactcttccgttaaatccgagtatgacaatccccaatatttaaccatgttatacacgatactaatgccaacgaccgctgacacgccaaccgtagctagtgacaaaatcggtgtgattggtgacttaaagacaaaaatcagcacaacaaaaataaaaataacagcgattaattctgttttggcgattcccttaccggtagcatcaccgaaatcttggtccaagatatcactacctgtaatgtaagacctgacttgttttgtagcagttgaggccgtcagttcctttttcattttcgtaatatcgtttgacttcactgttagctgtaccagtcgtgtcgttttatccttcgaaacgacctgtgacttcgcctcggaactatctcccgcatccgtcacaccagtaattttatattcggccgcattatctcgtagctttttgactgtttgatcaattgcttgattttgaacatcggtcaacggttgattaccatttgtgtatacggcaatgaccgttttcgcacccttatctttttcactaaattgattggccaatttgtctgcctgtacactctgataagagtccggcactgattggtcagatttcagactggactcgtccggaaagaaaactactgctagtgtcaaaattacagcccaaaaaacaaaccaaagactgttcctattcttgaaaagcttcatatcatcgcctaccattccaggtctaaaaaggcctctattcattggctttattatgtaagatgatggctttcaatcaaaacactatttttaatcaaatgtccgttatcggacaaaaatataataaacgcccaaaattggacttatatcaatttttttgcaacaaatatatacaactgccctgctggacaggttattcattggtttttatgttaacttaaacagatttatcagcttgcagattaaaaacgaaaaaagcctcgagatacatcaacgtatctcgaggcttttcaaatcattatgcgatcggcgggggtcgaacccgcacggtatctctaccacaggatccttaatcctgcgcgtctgccaattccgccacgaccgcatgtctgtaccgaaagtatcagcacagattatattatcagatatagcgcttatatgcaagctgactatatctcgtcatcattgttatgacggggttgcaagacctctaccttaacgtcttcagctggttcatcttctggatacttaataataatatcctcatcagctggcgttacatccttgcgtaccccaggttccgcttcggcttcagtttgttgtgacttatccttcttggtgatgtcattaaacacattaacaacggcgtccttgaattcaccaaccttgtcattaatcttagcttggttttctggatcagccaaataatcgccacccttttgtgcttgctcgcccaatacggtcacaacatcaccggtcttcttaacgaccttacttactacgtctaaaaatgccatggcactttcccccttttcttactattatacctggataataaaaaagagtggactatcatccactcttctcgtttacttttctgttggttcaatcatcgtcaaaccgattcgctcacgctttacgtcaacgtcaaccacccaaacagtaataatgtcaccaacggcaacaatctcgtgtgggttcgtcacgcgacgcttagccatgcgtgaaatgtgaaccagaccatcttcgtgcacacccaaatcaacgaatgccccgaagtcgaccacgttacgtaccgttccttgcaattgcatccccggcttcaagtccttcaatgacaacacatccgaacgcaacacagcacctggcgcatcatcgcgcaaatcacggcctgggttacccaatgatgcaataatatcttgcaacgttgcgagaccgatgccgaagtgatcagctgtcgcctgattgtttaaacgggccaatggctcttgcgcggcttcacctagtgctgtgacacctgcctcagccaacaaggcctccgcaattttgtatgattctgggtgaatgtcagtgttgtccaacgcgttctttccatctggcaaacgcaagaatcccgcagcttgctcaaacgccttagggccaagctttggtaccttcttcaattgcgcgcgtgacgtaaattgaccattctcatcacgataagcgacgatattggcagctgtcgtcttagttaaaccagcaatgtgcgttagcaattgtggtgacgccgtattcaagttaacaccaacttggttaaccgccgtctccagtaccgcatccaattccgtttcaagttccttcgttggcaaatcgtgctggtattgcccaacaccgaccgcttgtgggtcaatcttgatcaactcagccattgggtcttgcacacgacgggcaattgaaatggctgaacgttgctcgacttgcaagtcggggaattcagcacgcgccatatcgctagctgagtacactgaagcacctgattcgttaaccacgacatattgcaagtcaggcaaatctgacttaatgatgtcagctacgaagctttgtgattcacgagaagccgttccgtttccgatggcaaccaatgacaccccatactttttaaccaagttaatgatggtttgcttagcacccttaggatcgtactgcataccacgcaatgggtaaatgtgagccttctccaagaacttaccattctcgtcgacaaccgctagcttagaacctgtacgaacacctgggtcgtaacccaacacgacacggccacgcaaaggcgccgccatcagcaagtgatacaagtttgtgccaaacaccttaatggcatcccccgctgcgcgatcgaacaattccttgcgcaattcgcgttcgatagctggaccaatgaaacgcttgtaggcgtcgttagctgctgctgtcaaaacgtcggctgattcgccagtctttgacccaaccaagcggaacttcaagtaacgctcgatagcagccacgtcaacatcgatgctgcctgacaacacaccttcattttcaccacggttaattgccaaaatttggtggttcgccaccttattcatcggcatactaaagtcgtagtaaagttggaaaatgccttgttcgtccttatcacctgcgccacgcttttgcttagaaaccaagcgcccgtggtcacgagtatacttacgaacccagtcacgcaagccagcgttttcaccaataacttcggcgaaaatctcgtggacaccggccataacggcagccacatctggcaaatccttatccgcatcaacaaacttcgctgcttctgcttgcaagccttccgttgggaacttttgtacaaactgtgccattggcatcaagccggcttccttggcgatagtcgccttggtacgacgcttttgcttgtatgggagatacaaatcttccaccgcttgcatcgtatcagctgccaccaaggccttcatcaagttcggtgtcatcgccttttgctcagtgatggccttttcaactgtcgccttacgcgcttgtaaatcttccaaacgcttcgtggctgcttggatgtcacgaatttggacttcatccaagttacccgtaacatccttacggtaacgcgcgataaatggcaccgtgttaccatcagccaacaaatcagccgttgcggtcactttgttaagtggcaaggccaattcttttgctacttccccaacgatatcaatctttagggcatcatctaccgccgtcgtcattacattaccgtgttcatgatgcgacgaacttgcaccaagaacttctccatcaacgtatcttgatccgtctctgattgcttgaaatcgtccatgttaatcgtttggttttcaacgtccaatgactttgccatcatttcagtggcatcagcgtattcaccaaccgtcttcttcattgattggtgaacacccttcaaacgaactggggcagcgattgcattgatcttagctgaagcatccttgtaaacggcaacggcttcgtcaaattccattgcaatttcttggaattcggcctttggcatctcagccaccttgtcagccttgattgcgtcatccaacttctcaaagaaaggtgccaccttgttaccagcgtcctcagttgcttggataacagcccccaagtttgctgcgtattgttgtggtgaaacgaacttcgtcttagccatgaatagaatctccttcttgcctttaacggcactgataattaatcaataatgattctattataacaggtttcaccgtggcttaatcgccggttgcaaaacgcaatgcttgatccaagtcagccaacaaatcactaatatcttcaatgccgacagacaagcgaagcgtctctgggcgggtgcctgaagcgatcagctcttcttctgaaagttgtgcgtgtgaggttgatgccgggtgcaagatagatgacttaccttcaccagacgaagcaaaatgcgtgaatactttgacactgtccaacacttttttaccagcttcagcacccccgacaaccccaaacgtgaagattgaacctggtccctttggcagatattgttgcgcacgctcgtagtaacgattatcagtcaatccggcataattcacccacgccacagctgggtgttgtgccaagaactgggcaacacgcttagcattatccacgtgacgttggacacgcaaagataacgtttcgagacccagtaaaatcaaccaggcattgaatggtgataacgtagcgccagtgtcgcggagcaagttatagcgaatgcggttaatgtaggcggcatctccaaacttttctgtgtaaactagcccgtggtaactttcgtccggtgtggtcaaaccagggaacttatcattttgggtccaatcaaagtgaccactatcgacaatcacaccacccagtgctgcaccgtgacctaacaagaacttagtcgctgagtagaccacgatatccgcaccaaagtcgaacacgcgtgataggtacgccgtcgcaaatgtgttgtcgacaatcaatggaatacccgcttcgtgtgcaatgtcagccaacaccgttaagtcagcaatattcgagttgggattaccaattaattcaacgtacaatgccttcgtattcgcttgaatggcatttgtaacggcaacccaatcgtcgatgtctacaaacgtagtcgtggccccgcgacgtggataggcggtcgcaagcaggttatgtgtcccaccgtatagcgtgttagcagccacaatgtgatcaccagcgacggttaagttttccaatgcgtaattaatggctgccatccccgatgaaacggccactgcgcccacaccaccttctaacaacgccaatcgatcttcaaggaccgctgtcgtcggattggtaaagcgcgtataaagttggcctggcttctcaagcgcaaattgtgaggccgcatcatccgcgctgtcatatacatatgacgtcgtttggtaaataggtacactcgtcgcatgtgcctccgcgtcaggtgtatatccaccatgtaaagcaagtgtgtcgaaattcaattctgattctgtcattcttatgcctcatttctaaaataaaaagcccgtttctaccccagataaattctggaatagaaacgagcttgtcgtgttaccattctatctttattggccagttacccggcgcaatcttcataacgtacggtcagggtgcgagatgatgcattgacgatacgcgtgtcgttgtaacggcgaccaccccgttatgcgctcataggcttgccactcacgcataccaatcacaggccattttcatcagctggttaatcactgtctctcatcattcaacagttttctgtgcatttcccaaggctaactactttcctgctcaaattgtttctcattattttttaacaatattgattttatactctaatttttagtaagtcaacaacataaaaaaacaccggtacgagatgccctatcatctcataccagtgtttgattttatttataggttttatgcgtaacgccttaatctaacgaaattatgcttccgtatccaacaaagcatacttgccatcacgacgcttgtagacaacagctggtgtgttcgtctcagcatcttggaagatgaagaactcgtggcccaacaattccatttgcaaaacggcttcttcagcatccattggcttcaaagcaacgtgctttgtacgaacaatgtccaaacctgctgcttcttcagcctcagcttcttcaacttgctcttcaacagcaaagtccaattgctcgatgcccttgtatcccttttcacgagacttgcggttaaccttagtcttgtacttacggatttggcgctccaacttttctgacacgaagtcgaccgtttgatacatgtctgattgcgtatcttctgcacgcaacaacaagtatggcaattggatcgttacttcagtcttgaatgttccttccttgtaagaacgaacattaacgtgtgctacatacttagcatcatcattcaagtaacgctccaaacgtgacaaacgcttctcgatgtactcagtcatcgcgtctgtgacctcaatgttttcaccacgtaccttaaattctagcataattctgtctcctatctgacttattttgcgtgggcctagtcccctaatatggcttcacgcatctcccaaagtattcttgagatgtcctttcggtaactatattgtaacactcagatgacaagagagaaagcgttttcataaactgttcatagctccgtcatctagctaaggtaatcgtgcatatctgtttcgcaccacattcatataaacacgtcgcagcatgtcgcaaggttctccctgtcgtataaacatcatcaactaagcaaattctctgaccagttaaatcaagattacccaattggcacataaatggttgtgccgtatttagacgatcctgacgtgttttcaatgattgtacactcttgttatgcgatatacaacatagaatatcatctatttcacatatttctaatagaccattaacttggttgaacccgcgcatcgctaacgtatcgggactaactggaattggcacaatcatatccactgaaacttcagccaaccttttctgcaaggcttcttgaaaaatagttcgcagatgataaccaccccgaaacttatatgctgaaagaaatcgtgcatcatagcatcgtatttaaacaacgcttgattcttaagtggcggataaccttctcctaaccaaacctggcaatcttcgcatgtttcttggcgtgaggcccggccgcactcttggcaggtcggcccgatgattggcgtgaacttcccccaacagtcctgacaaatcggctgttggctctttggtttgaactgccaaaaatcccataattgccaagtttgtgcaacgccctttccgcaaaactcacatctcataacttcgccccatctgatttaaataatttatctcactgcgtgctgccagaagtgtttgcgttttttcttgaacaaatgccgtaacgttaccgaatggtcggctgctactacgcccacaacgcccagcaatttgaatgagcgctgcctgactgaacaccgcatcatcagcacctaagataatcacatcgatgcccggaaacgttaccccacgctccaaaatggtggttgtaatgagcgcctgtaggctttcgtcgcgcattgcctgtacctttgcttgtcgctctgaatcagtggcgtgcgtggatgcaatggccatatcaggtgtgccatgatgaaccatcgttagcaccgtatctaaatcagcgactgacggcacaaacagtaaaaatcgttgaccagtttgctgatatgtttgtagtaattgtcgtagttgccggggcatctttttgcgccactcacccactcgccttatcgtaaaattcggcagtggattgccatgaaaacgacgtggcaacagactaattgccatttgtctacgccgtacttcacgaagcaaacgcgaactcggtgtcgccgttagatagaaatgcgatccatgtaatgcagttgcttgatgtaaggcaccaatcagctgcggattttctgcgtatggaaaagcatctacttcatcaatcacaatgacatcaaacgcttgtttaaagcggagcaattggtgcgttgaagctaggaccaattgtgtgtagcgatagacatccggtgaatcgccataaagggttacaaaatcggtgataaacgccgcgcgaatacggggcgctagttcaacaatcatatccacacgtggcgaaacaatcgcaacgcgttttcccgcttgcaatgcgtaggttaacatcggaaagagcatttctgttttacctgcaccagttactgcatatgtgagatgagagaccccattctccaaggctttgatctgttcatacgccactcgctgttgagccggtgttaacgttcccgtccacacacatggctctggttcaatttcataggctcgtggctcaggtatggtcagtaagacatcttggcttgaaaggcgtcctaagttggcgcatgcccagcaataagtggccccatctaccaaaagccaatgcggtttaattgttgtcgcacaccgctgacaaatttcattttcgattgctggtgtcattacgacattagccggcgttgatactgtattggctgccggaactaggcgcccatataataaacttaagtcaaattccataacatcccccttataaataaagaggggcgtttaccgtttttgtccaaaaaaagagcatattgactctctgttcaacatgctctttcaatctttaattctttttgacgtcaccgtcagcattcttcgtaaccttcatatcagaaactgggatgtatccaagcttcttaatagtcgacttcatggcctttgattgcacaaatttgatgtaagactttgtattcttatcagtcttcttcgttgtgtacatgtgctcgtaggcccagatttgccacttgtttgatgcgacgtttttatcagttggctttaccttatcaatggcaaccgtcttgatacccttagcatttggtcctgttgtgtatgagaaagccaagtatgaaatggcaccaggcgtcgttgacacaatcttttgaacggcaccattatcatcttgttcttgtgatgtcttagcgctctcgccgtccaaaacatcatgttcaaacgtgaaacgtgtaccagaaccttgggcacggttaactaggacaatatcttcatccttaccaccaacgtccttccagttagtaatcttacccgtaaagatgtctcgcaattgttccttggtcaaagactttactggcacatccttatttaccactggtgcaataccaacaactgctactttatgatctgttagctttttagcatcaaccccatccttctgacttgcaaaaatatcagaatttccaatggttacgccacccttaccaacttggctcagaccagctccagatccaccaccttgcacgacaaccgacacaccaggatgcttctctccatacatctcagcggcttgtgacgctagtggttgtaaagcggttgaccccacagccaacacttgcttcttctttgcggcatttgcatcatgcccaaccaatcccccggctaatacgagaacaacagtacttcctacaacaagctgcttcttattcatcactgactccttctatggtcatgtattattcgagttaggtcgcaagcggtaagcaacagttagtagtagcagactgaagtgaggcgcttaccccttacgacatctttaagtatagtgaacctttgtatgtgtttcgtcagtgttgtgtcattattgcgttgcgtttttgtaaatagttactttacaaacacacaaaaaaaccgcaccatttctggtacggtttacgttgcatcgcgacgtcctatcctcgcaggaagcgatcctccaactactttcggcgctattgagcttaacttctgtgttcttcagaacgtgtagccaatgtacaagcaatacgcatgattgcttcattttggtttgatgatgtcccggtagaaagtacaaattggttggactttatgaactatcttggcttgcaatcgcactttgaagcgatggtcaaagatagtatctacgaataaacatatacgtgcagaaaggaaccacgttaaaagctgaaggagaattaaataatgaacattctgatcgttattttaagtgtactagttgctttggagttctttttcattatgtatttggaaacattcgcaacaacttcatctcgtactgctgaaactttcagcatgtcaaaaaatgatcttcaaaatgaaaagataaacactctacttaaaaatcaaggtatttataacggtcttattggcgttggaatactttatttgttgatttttacgcaaaattacaacaatagcttgttttctattatgctatacattattttggtggcattatacggaagtttctcatcaggaaacaagtcaattttcttcaagcaaggaactttggccgtcatcgtggtagttttgttgttagttcaaatgattctgggataattagcaggcattgctaatcaggggtctgcgcaatattgcgccaaccaaatgggggttcgttaattttgacgataccctaaaaattgaggcctgctgaaaagtcggccacctcttcacatactcaaaacttaatgccatacatagagcttgggcactcgtatggaaaggctaatcatgagtatcaagaaacaaaaagacggcacctacactgtccgcgtccggtggactgacgggcaaggcaagcgccgtgacaaaataaaaactaagttggcaaataagacgttggcatctcactgggaacgtcaaacgttactagatgcagagtccggcaagtttgataaggtcagcacctacacaacggccaatgagcttgttgaaatgtggctgaaagaatacagccgtaataagcgcgatactaccgttagcaaggtacgccgcttctttgaaatgtatgtgctggtgcctgaatggtttaacgacgttcaaatcagtactatcagtcgcaaggacgttcaacgctggacggactggctggcatctatccacgccacttataaaaagcaggtaacgtacttctcaaaggtatttgacgttgctgtggcttatgagctgctagagagcaacccgtttaagtctattcgtctaccaacgccaatcagcaagcctgataggtcttaccgtgtggacgtttacgataggccacaacttgctgcgtttatggatgcggtgaaagacaaatacgacaatgtagatcagtatcacaagctggcctatttgcgactactggcatttactggtatgcgtaacggtgaggcacgggcactaacttggtctgatatgcatttggacggggatgagccgtttattggcgtaaacaagaccatgagtgacaacacaggtcacggtgtcgttatcaacccgccaaagaccaaagccggcagccgtaaggtcatgatagatgctgaaactgcaaatatcttgaagcgctggcgtgccattcaaggccgggctctcatgcgtcgtggttcgccgtctaacgtcgtttggactaatcagcgtctatctggccgtatcagttcaaatcaacctagagagtggctgttggctgcaatcagaggcacagacgttccacagataaacgtacacggtctgagccatacgtacatcaccctagctgtccaggctggcatggatattaagacgctccaggcacaggtcggccacgatgatataaacacaacgttgggtgtttacgcatccgtcaccaaagaaatgcgtgcaaagaccgctgatatattcacctcactagtcaatttctagtaaatgtgtatctaactgtgtttttagtgggtgagttggtctgggtatcagacgcataaattgaatacaaaaaatgccccgcgtgacacgctacaaacgttgtcatacggggcattgttgtaaaattcaactcacccacttagtcacccacttgcgtacaattcagtacaatttagtacaataaaaagggtgtctaactgggggatttgcaataaaaaaacgttgatatacgggcctaaatgcctatatatcaacgtttccaaaatctactaactgggcatactggattcgaaccagtgcatgacggtaccagaaaccgttgccttaccgcttggctaatgcccaaaatcaacttctatatcatacaacacacactctatcgatttcaagtccaaaaagaaaacgaccaagtcccctcaaacctggtcgttttcgtcttaacgctcgtctaaattgcgcgctttaatcttggcctttgtctttgacacgaccttatcgtcgaattgacgaataaacgccaataccttgtgggcttgctcttccccaaaagcttgtacccaaccatcgaaacgattctcaacacgcttcgttacgattgcttcaacttcacgacccgtcactgttaaatgcaacaacatccggcgtcgatcagctgtatccggttcctggtagatgaactccttcttaagtaacatcttgatttgtcgtgacacagccgcacgggtcacatggcgacgttcaacgacatccgtcaacgtcaggccatcttgttgtgcaatgctatgcataatcaagtattgttcgaatgatagtccgtaatccgccgctggctcagaaacaacttcatccaagtatttcagagtcgacaaatacgcgtcgatatactcgcttaaaagctccattactgcctcccaaaaaatatcccaaagatttttataacgctaactattgtacagtaaagcacatgccttgtcagccgaaaaagaggatatgaaaaaagagaaccgctaaaactagcaattctcttttaatctttattaacgaacaatcatcactgtgattggggcattattagccacatagcttgattgcgaaccgaagtacttctcagcacccttttgtgagtgtgatccaatcacaaccatgtcggggttaattgaaggaatcacatccttgacgataacctcacctggctcaccttcagacaaaagcgtctcaatgtttggaacaccggcatcaactgccacttggcggtaacgctccaatgcctgttcaacatcttcgcgagctgctgcgttcttttcctttgaaaagtaatcgaacacattcatttgatcagcttcaaatactgacaaaatcgtcaacttagaaccatcttcttgcgcttggtgaattgcgttcaccaaggccaattgaccaagttctgagtcatcgacagctgccaatacgtgcttgaaatgctttgcttctaccataagtttcgtctcctattacttaaatagcggtgcgaccgtgttgaaaatcaattgaatgttcaatcccgtcaagataaccgaaatcgcatatcccaaccacgttgcccacttaggatttacaaactcacccatgtacttcttagatgacgtaaagtaaatcaatgggaacattgagaatggcaaagccactgacaagaagacctgtgagtaaaccaacagcttatccaaggcaccttcagttgctccgaacacaattgcgaagataacaatcggaatcaacgcaattccacgggttagcaaacgttgcaaccacattggcaagtgccagtgcgtgtaaccttccatgatgatttgaccagtcaacgttccagtaatcgttgagttttgtcctgatgccaacaaggcaaccgcgaacaacatactcaagacagggctcgcaatggcaccaacgatttccttgttgttcaaggcgttgaacaaatcaccaaaggcttccaaatctgagccgtgaccgaagaacaaagctgctccgacgatcaatagcaatgaattaacgacgaacgctcccgtcaattggatatttgaatcccaagtcgtaaagcgaatcgcttccttaatactcttgtttgatgaacggtcaatcttacgtgtttgtgagattgatgagtgcaagtacaagttgtgtggcataactgtggcaccaacgataccaagagccaacatcaattgtccgtgcttcaagatgtcactgtgtggcaccaagttcacggcaacttcacccatatcaggcttagccaagaccgccatgtacaggaagacaagcaagataaccgcaatcaacgtgacaacgattgcttcaatcttacggaaccctaacttcatcaatagcaataatagcaaaacgtctagggcagtaatgatgacaccccatagcaatggcaaaccgaacagcaagtggatggcaatcgctgcaccgataacttcggccatttcagtcgccatgattgcaagttcagtcataatccatagaatatatccaacgaattgattagtagagtcacgtgtcatttgggccaggtctttctgagccacaattcctagtttagccgccatatactgcaacaacatcgcaattaaactagacactaagatcacagacatcaataggtagtggtattgtgcaccaccaacgattgatgtaatccaattacctgggtccatgtaacccacagcaaccaacgctcctggcccactccaggccatcaacttacgcaaaaatccgccgccttgtggaacttccactgtgctgttgatttccgccaaacttggaccaccagacgcttgtgcgtttacgtctgccggatcctttactgaattttcgctcatcagtaaatatgcctccttgttttttggtacgactcattatcttactaaaagtatcttttgtaaaccgtcaaagcccgaaatgacgcggtttgaacaaattgtgaactttccgtgttttgggtatgaccccttgacaacttccaaaaaataatgtaatttagaacagttgaaaaaataatcgattattaataaacactgcctactttctacacggcggtgtaagggaggatatatctatggcagttcctgcacgtaagacttcaaagaacgcaaagcgctcacgtcgcggtggtcaaggcggacttaagacgcctgctatccacatgaacgaaaacggtgtttacgtacgtaaccaccacgtggccgctgatggttcatacaagggtaagcaagttgtttcacctaagtaattagcgacaaaaagacctctaggattcgtcctagaggtctttttttgtttcattttctaaacagtcgttgcaacaacgagcgatgcggctctatcggctcaacgccaagcagcgttgcttcatgagtttcttcagggtccgtcaccccatcccccaactgatcaacaacgacatcatatacatcagctactcgtgggcctattacaacctgatattgccgtagcggttcgttatagacagctcctgctactttatcaagtttcatcaaagcgcccgtattcgccatgctagggtcctttaaatagaagcgaagtcgtgtgacacagtgaataaccttattaacgtttcctgcaccacccacgttgcgaataatcgctgtcgctaatgaatcatacttctccatgtcacctttcaccccttccaattatctacttccattttagccttagcatttgattaactcacgcaagaagcattgtcagaatgtgggtgaaatatgcaaaaaaaatgccacgcatttcgaatcgagatgcgtggcattaattatttatgattacatttcttgctcaaagtctgatggtgagtacaacttcaagatcttagtaaacaagaagtcgactacgaaaccagcaatagctggcacgatgaaccaaacaatcaagaattgaacaaagttgattgtgtgcttaacgatttcagcttcagcagcgtcaaacgtaaacattgattgcaatggtgaaaccattccaatccaaccgaatccggctgaagttggcgttccttgaacgttgaacaaagcaactgggatagccgtaattgctgcggcaaccaagaaggccaaaatcataactggcttcttaaatactgaaggcatcatacccttcatagcacccaagaagatagcaaccgtcgttcccttcttgttaaccttccatgagttgatcaacaggataaccgtcgttgcaacaacaccggctccggcagcaccagcacccaaacctgacaacgtgattgccaaggcaataccaaccgttgagattggcgtgatgatgatgaatgagaaggccattgcaatggcaattgacattggcaatggttgcaagtcagtagccaaacgaacagcgtcaccaacccaagtcgtgatgtaagcaacgtaaggtgcgatagcgcgaccgaacaaagcaacacccccaccgattacgattgggctcaagatgatagcaactgaaccaaatccggctaggtaacgtgataccaaccagattaccaatactgcaaccgcagcaacgataatggcgttgataacgtcaccggcaccagcagcaatgtaaacattaccaacttgtggtgcacccgtaattgggtttacgaagccctttggtgcaacggcccacttgattgatcctgaagcagcaccaaccgcaatagccataacaccaacatcaagcgccttcatacggaattgcatagcaattgcgacaccaatcaacaatggaatgaatgatgagaacagcgtcaaaatagctgacaaatcaagcgcccattgcgccgttccgaacatcttcaagatgtacttcataacggctgatggcaaaacaccaatcaagataccttgggctgaaccagaaagtaccttgaagaagaaatcctttaactttagctcgtatgagccgtcaaaaaattcgctcgtcataatattaaattatacctttcaaaccaaacgtctctcgcaccaaatagttactcacttagcgaatctcacaacgtcaaatgagttatttgaaggaggataaacaataaaataattttttacttaaagtaagttatcacgattagtattcaactgcaatagcaggtgtctcaccgttaatgaatgccaatgaagcgtccattgattggtgaaccatttctagaacagccttagtcgtgtagaatgccgtgtgtggtgtaaccaatacgttctcacgagcaatcaaatcagcaatctttgcgtcagggaattccttgtctgaccagtcaacgttgaacaaaccaacttcttcttcgtaaacgtccattgcgaagtctgaaatcttacctgagttcaaaccatcgataacagcgtcgatgtccatcaagttaccgcgtgaaacgttaaccaagacaacaccgtccttcatctttgcgattgaatcagcattgatcatgtggtggttagcaggaacacctggtacgtacaatgagataacatcagcttgtgcatacaactcgtccaaagtatcaacgtagatgccttcagcttccaattctgcgttacggtatagatcgtaagcaataacctttgcgccgaagcccttcaagatgttgatagcaacacgtccgatgtgaccagttccgataacaccaaccgtttgcatacgaacttcacgtccgattgttggtgcccaacgcaagtcgtgctttgcaatctttgcatccaaagcctttgcgcgacgcaacaaacgtgacatttgaatcattgagtgctcagcaatagcgtttggtgagtaaactggcacgtttgagattgagaagtcaaactcgcgtgcagcatcgaaatcgatgttgtcagtaccaacgttacgcaatgacatcttgttgatgcccaactcgtgcaaagcagtcaacgtctcgcgtgtgtagtccaattgttggtaaacgttaacagcgtcggctccctctgccaactttgctgtctcagggtccaacaacttatcagtgtagcccacttcaacttctgggtgagctgcaatccactcgttcaatgatggcttttcgtcttcgcgaataccgtaagcaaaaatcttcatgcttttttcctccaaagcgtttcttaacacttattcattataaggtaacttgtgaagaagtcaacatgttttgtggactaaggcaaaacgattatcccgcattcggtactccatactttttgtgtaccggtataccactactctttattaaggaaaccgcctcacaaattttttccaaaaacccatgaacttttattcacaaaggcgcaaatattttccagaaaagcaaaaaggcgcctccacaaaacgggaggcgccttccttctaaaaagaggcagtattacttttgctcgttggcgctcgtcatgatcttatcgaccaagccgtactcaagtgactcatcagcatctagccagtgatcacgttccgtatcacgctccaattgctcgtaaggctttcctgtattgcttgccaaaatttcgttcaacttcttgcgagtcttcaaaatctcttctgctgcgatagcaatttcagtttgttgtccttgtgcaccacctgatggttggtgaatcatgaattgtgagttaggcaacatgaaacgcttgcccttagcacctgaagatgccaaaacagacgccattgatgctgccaaaccaataacaatcgtttgaacatcagccttgataaagttcattgtgtcgtagatggccataccggcattaacttctccaccaggagagttaatgtacatgtaaatatccttatctggatcttgcgcatccaagaatagcaattgggcaataattgccgttgccatttgtgattcaattggtccactgaccatgataatacgatcaatcaacaaacgtgagaagatgtcgtatgaacgctccccgcgtgatgattgttcgataacgtatggaattggtaacattatttattttcctcctgatgttcagaatcagaacatacccctattgtagacagttcgtcaaacatggtcaaacgatatgagccatcctatgaaattcctttaggaagcgcgcctgttgtgcgcaaatcgtcagccattttcgtcaacttacgtaggcggtgattaaccccagactttgaaatttcacccgatggcacatacttaccaagctctgacaatggctcttcacgatgcgccaagcgaacttccgcaatctcacgtagcttttcaggcaaacgggccaaaccaatctcattatccaaaaactcgatgtcatcgatttgtttttgactggcgttaaccgtcttatccaagttcgcgttttcagcattcactaaacggttaaccgaattacgcatatcacgaataatacgcacgtcttccatcttaagcatggcattcgtcgccccaatgaccatcagcatatcaccaattttttccgcttccttcagataaacgatataacccgagcgacgttcaaccaccttcgcattcaagtcaaagcggttcatcagctcttccaattggtgcgcttgctcttcatatagagaataaatctctaggtgatagcgacttgtctctggattgttaacagaaccggccgccaaaaaggcaccgcgcaagtaagaacgagccttaccttcatcagccagccattcatcaggaaccgttggcaataattcaaaatcctcaaagatgtgcaaatcatcaagcagctcatttacaccttgcacaattcgcacgacgtacaaattgttcttcttcaatttcatttgacgacgcaccgaaatttcagatggcaattgataaaattgttgcagcaatcccaaaatacgacgagctgtcgccgcattttcagtttgcacattcaaggtaaatcgcatgtttgataggcccaacgagccattcatgcgtaacaaggcggacaactctgcctttgcattgtccggattattaatttccagcatcgtcaattcttttttgacatcactcgcaaatgacataagtttcctcccttctacaattctttcgcgtcagcaatttgcataatcaattgggccacgatgtcaccatcgtgaaaggctccatcgtcacgcaattcaagcaggtcacccaaaacagggattgcaccttcgtgacgcacttcttctggatcaaaggccacttgatgtgaaacctcattccactttttccaatcaatatagtcatctggcacaataccagtattcataatgacggcatcaaccacattatcaccaacatgcttattcaaagcccgcaaatgatctgcatcagagaaatcatccgtttcacccttttgcgtcataatgttagcaatgtataccactttggcacgcgtcgccttcaacgcttcagcaacgtttgggacaaccaagttaggtaagatgctcgtaaacaaacttcctggtccgagtacgatgacatccgcattcaaaattgcgttaataacttcactcggcgcttgggcaacctcattcacagaatcaggttgtggcgtcacccaaatgtgatcaatctgcttgtgggcagccgtaatttctgcttcacctgacagttccgtaccgtctttaaacttagcgtgcaaaatcaacggttcattagctaccgggtatacgtgcccttggatgcccataaatttcgtcaacaactgcacacctgcaaagatgtcatgttccttttcagccatagcagcaataatcagatttcccagcgcatgattggccagcatttcatcattttcatggaagcgatattggaaaatatcgataatctcttgtggcaatgtcgatagcgtcgccatgacgttacgaatatccccaggtggcacgatgttcaaatagtcgcgcaatgtcccagatgaaccaccatcatctgccaccgtaatgaccgctgtcaaatccgcgtcgaacttcttcaaaccacgcaaaataaccggttggcctgaaccaccaccgatgacaacaatcttcggtgccgttttaaccgtaaattcttctgtcatgatcggttactgctttccttgcgacggttgatgtcacggtgatactcattaaccttccagtcgttagccaaatcttggctcaaacggtgtgcaaaggcaactgagcggtgttgaccacccgtgcaaccgaaggcaatcgtcaaagtgctcttaccttctgccttgtacttggggagcaaccacttaatcaagctactctcgcgttggtagaattcttctgcatcttcacttgaccagacgtaatcccagacttctttatccaaaccggtttgctcacgcaaggccgtaatatagtacggattcttcaaaaagcgtacatcgataagcaagtcagcatcgacaggtacaccatacttaaagccgaaactcatgacttgcaccgcaaacgtgccttctcggtcttcatctgagccgaagtgttccaagatgtagttgcgcaattgacgtggcgcaaaatcatctgtatgaatcacttcacttgccatatcgtgaatttcagtcaaacggtgacgctcagtttgaattccgtacaacgtgcccttgtcgcctgacaaaggatgtgaacggcgggtttccttatagcgtgccaccaactcttcgtcagtcgcatcaatgtacacaatcttcaaatcgtagtaatcattgttgtcggctgacatcttcttaatttcatcatccaaatcatcaaagaaactttgtgatcgcaagtcaatcattaccgctgcacgttggatgttatcttcatcagaaatcatctgccagaactttggcaacattgcaggtggtaggttttgcacagtaaagtagcccaagtcttcaaaggcctgaatcgcaacagttttacccgaaccactcattcctgtgacaataaccaattctttcttagccatggtttccgtcctccgtttttatcgtgctaacattataccatttattggacacgcccggctatgtggttaatcatttcgcaaacaacggcacaaaaaaaccagtccaccgcggtgaactggtttctttgattacttcttgttgcttgctgccttgcgtgcatcgtgcaatgccttcaaagcgcgcttgcgagtcttaatgtttgggctcttcatcttacgacgagctgatgccacatccaacttttcagccatgatgtttacctcactttttgttttatatattcgaataaatagaacttacaaaaagaaagtatacacggttacccgcatatcggcaaccaaaaagggcgattttattgtaccgctgctgcacgggcgcgatcacggtccataattgggccaagatattgaccagtgtatgactctggtactgctgcgatgtcttctggtgtaccagtcgcaagaaccgttccaccgccttctccaccttctggacccatgtcgatcaaccagtcagccgtcttaatgacatccaaattgtgttcgataaccaaaacagtgttaccaccatcaacaaggcgttgcaaaacttctagcaaacgtgaaatgtcatccacgtgcaaaccagtcgttggctcatccaagatgtagaatgtcttaccggttgacttacgttgcaactctgatgccaacttcatacgctgtgcttcaccaccagacaaagtcgtggctgattgaccaagcgttacatatccaagaccaacatcaacaatcgtttgcaacttgcgacgaatctttggaattggtgcaaagaattcaactgcttgttcagccgtcaagttcaacacatcagcaatcgtcaaaccgcggtaagtcacttccaacgtctctgagttgtaacgcgtaccgccacaaacttcacacgtcacgtaaacgtccggcaagaagttcatttcaatcttgatgacaccgtcacccttacatgcctcacaacgaccacccttggtattgaatgagaaacgtcccttgttgtagccacgcaacttggcctcgtttgtttgtgcgaacaaggtacgaatatcgtcaaagacacccgtgtacgttgctgggttagaacgtggcgtacgaccgattgggctttggtcaatatcgacaatcttgtcaacattctcaaagccagtcatcttcttgtacttaccaggcttttcagaattgttgttcaattccatcttcaacgcacgcttcaaaattgaattaaccagcgttgactttcctgaaccagacacacctgtcacggccacaaacttacccaatgggaagtcgaccttaacgttcttcaagttattttcagcagcgccagtgatggtaatcttttgaccattaccttcacggcgtgtttcgggaactggaataaacttctttcctgataggtattgtcccgtcaatgaattttcattggcttcgatttcttcaggcgttccagtagccataatctcaccaccgtgatcaccagcaccaggtccgacgtcgataatgtaatcggctgccttcatggtatcttcatcgtgttcaacaacaatcagcgtgttacccaaatcacgcatttgcttcaatgaattgatcaaacggtcattatcgcgttggtgcaacccaattgatggttcatccaaaacatacataacccctgataggtttgaaccaatttgtgttgccaaacgaatacgttgggcttcaccaccagaaagcgtacgagcagaacgagacaacgttagatagtccaacccaacgttcttcaagaagctcaaacggtccgtaatttccttgacgattggctcagcaatttgtgaatcttgctcaccgaacttaacatccttgaagaaatccaattcttggtcaactggcatttctgaaatttgaccaatgtgcttgtcaccgaccttgactgacaaagcagctgggttcaaacggtaaccaccacaagcagagcaagttaattcgtccatgtaaccgcgcatttgctcacgcgtaaagtcagagtttgactcacggtaacgacggtcaatgttattcatgacaccttcgaatggcaaataaacgtcacgcacaccaccaaagtcattttcatagtggaagtggaatggcttcaaacgagaaccgtacaaaaccatatcttgttgatcagcagtcaattcctcaaacggcacatccattggaatgccaaattgctcagcaaattgacgcaacatttctgggtagtatgaagaagagattgggttccaggcaacgatagcgccatcagccaatgtatttgacttatctggaataacacggtcaacgtcgacctcaagtgtcatccccaatccaccacagatttcacacgctcccatgggtgcgttgaatgagaaaagttgtggttccaacttaccaactgcgaaatccttaagagcgcccgtgtagtgatcagaaaatgtgattggctcgccaccaatgacatccaccgtcaccacaccatcggccatgcgcattgctgattcaaatgattcgaacaaacgggcacgtgaaccgtcacgcaaaataatacgatcgaccacgattgagatgtcgtggtacttgttcttatccaagtcgaattcatcggtcacttcatgcatctcaccgtcaacgacgacacgcacgaaaccttctttttgaatacgctcaaaagctgacgcgtgtgaaccacgcttgtgacgaacgattggtgacaagacttgcatacgtgagccttcgtcgagagtatctgtcaaatagttcaacatttgatcaattgacgtcttgacgatggtgccgtcctcagctggatctggttgacccacgcgggcgaataacaaacgatagtaatcgttaatttcagtcaccgtaccaaccgttgaacgtgggttctttgaggtcgtcttttggtcgattgaaatagcaggactcaacccttcaatcgcatccacatcaggcttatccatttgacccaaaaattgacgggcataggcagacaaactttcaacgtaacgacgttgcccttcggcatacagggtatcaaaagctagcgaactttttcctgatcccgacaaaccggtcattaccacaaatttatcacggggaatcgccacgtccacatttttcaaattgtgagcgcgcgcaccgtgaatgttaatccagtcgttggccatatatttgcggcctccttcatgtagttttagttagttcttattataccctgaaagtcaaaaaggtgttagttataacctaacacctttctatatctattaaatttaaataagtaattattctgtatatggtttgtcattacgcaagaagattttgaaccaaacgaagttcaacaaccctagcacaagcataaacaggaatacatttcgggccccaactgcggtttggtgcgccacactcgcatgatcagttggattcacgcgcatcaacaatgatgcgattgtcgttccaattgcccctgcgaattgttgtgcagtgttaaagatggcattaccatccgcgcgctctggcaatgacaattgcgccaatccggctgtcatagatgttccaaaggccaagttacgacccaatgtcatcaacaagtagaaaattgtcattgagataactgttgcattcaacgtcattgctgaccaaactgccatgacaacaacaaacaaaaagtttccaagcaacaatggcatcttagccccgcgggtgtcgtaaagacgaccgtagattggattcaacaacgcaccggccaatgaacctggcatcaaagcgaacccggcaatcatcgtacttgcaccaagcgtcaattgtacaaacgttggcaccgcaaagttaaccattaaattggtaaacatgtacgtcacataaccaagcatcgcaaagcgcaaagccttcaccttaaagataccaaggttcaagaattgcttattgctgtgctttgagcgatacaagaaaccagcaaacgccgctaccgccaaaacgaatagcccgaacatgatgacatttactgaaccgtgctctagttggctcaatgcccacaagaaactcgtgaaagctaccgccagcaaagcaaaactcaaataatcgaacttaaacgcatcgttacgcgtatgatccgttggaatagtcttatacgtaatcaccaacggtaagaaagcaaccggcaaaactaacaagaaaatctcacgccaacccaaataataagcaaccactcctccaaagattggtccaaaggcaggcgccaaagagagaatcatcgtcccgaagcccatgtacttaccaatttgtgacatcggcacattttccaaaatgatattgaacaccaatggcgtaatcacgccagtcccaatcccctgaataatgcgtccaaccagtaacaaggcaaatgagtgtgacaagattgccacaataaccccaatcaaaaacgcaataatggcaatcataaaaatcatacggggattgaattttgctttcaagaacgccgacgttgtcatgaccaatgacaccatgagcagataggctgtggttagccactgcacaacgctaagtgaaatgccaaattgtttcattaaatccgggaacgtaacgttcattgacgtttccgtcaatattcccgtaaacgccagaattcccgttccaacaattgcccaaataatctttgggtcaactgcttgtgtgtcttttttcatatatctactcccatcaatacaatacgtttagtttgtcatatttacccactcggtacaaggttccttttcaaaaccgtccgaattcacgtataatagaaatattgaaatttagttggagggaaacaggcatgcatcatccagtcgcaaagccatggtcaatcaagtggattgcccagcacatcgcatcattcattttgcttaccggtgccgtgttagcggcagcaattgctttgacagccttaattattggtatcgaagaactgattgccttagttgttgtacaacgtccaatcaacacttacacaaacgtttacggtaacgctctccaaaccgttttgtggcacttcttgattgtgttctcattggtttccttctggtcagccgtggatacattcattccggcaccacctaaaaaataagattaaaaacccgttcctgaaccacatgtgttcaagaacgggttttcattttactttagtttttgcggttgcaatacaactgtcgtggccgtcaacatcaccaccaagccgagcaacaaaccagccgtcacatcgcttggataatgtacgcctagataaacacgactgatcggtagcaatacaatctccgctgccaatgccagcatgacaagcgtttttagccaacgccgacgcaagtagaaaaacgccaacactaacagagcgccataaaacgccacagcattaaccgaatgtcctgatggaaaagaaaaaccactctcaggaataatccgatcaaccgttgggcgtggacgttggacaatcgtcttaatgattttcattaacagggttgatccaatcacacttgttgcaatatacgctgcaatacgccaacgccgacgcagtgcggcgataatcaccacaattgctgtcaaaacaaccccagtcgccggttgcgcgaagaacgtcaccgcctgaaaaagtgcggtctttgttgcactaaagtggcgaatcaatgccacgccactttcatcataagccgttacccagcttgcatgttgcatgacacccaccgtcaaaacaacaaataagactgccgcaagcacgctaatgcctgttgcaagtttcttgtgccacatctctataatcctctctagaaaaaccttggtgaggcggtgcgatgttgcatctcaggaatcatcatgacgtgcaattcatgcgccggcacataatttatcccgctcaaaatagcttcacccacgccttgctcggcaatccgctttgccattgggacgaggcttggcaaattcgccacatcatccatcgtattcaatcgatgaatcaaataattaccaaactgacctaataattgggccggcaaatccaaagggctttgcgtcgtcagcatcaaatacaggccagctttgcgtccctcgcgcgcgacacggaaaataccatcactcgctaaatccgcctcactcaaataacgatgcgcctcgtcaatcaacactgttaccggtaaggtgtttgataacgtttgattaaggcgcaaaagagccgtcatcaataatgacacaataaccttacccaaacctaaatcatcggcgtaatcagaaacgtcaatcaccaaaaacttatgtgagctccgttgtgtgctgaacaactgcattaagtacatcacatcagttcgcatcgccaccgaagtgtcacgctcgcgttgtggtagattcagcaatttttgaaaacgggcatccgccaccaagcgggtcatgcgacgcacgattggcaacaacttacgaaatgcctcatggtcaacttcttgaccaattaagtcaaagtcatcaaccggcactgcaaattcttgttgtaattgcgctggcaaaagtgtcatatcagccggctgttgatagtgatacaacttgcccagcaattgttcatgcacagtccactcgcgaccgactttgccgtaaatgccgggttgcttcacaacattcatctgcaacttcaaactttgccaagcgtctgccaccttttcgacatcactcgcctcagttgccccgaaaaagctcgccaattcagtgcccgtcaaccgttcataatcaatgaacgcattacgccccaacttcgcaacaaccgcattgggtagcgtcgtatactcccctgtcggatcaataataatcgttgattgatttgcgtctaacaagccatgcaaaattgtcacggcactggttgatttaccactaccagttgcccctgtaatcaataaatgttggcgtaaaagatcgtcagctggggttgagaattcacttgtcagttgaatatctaccatcagaatgcctacttcttaacctttttgaaatatggtgcgaccgcttggacaagcgtaatccacacgacggagaaaactaccaagccaatcaacaccccaacggtttgaccgaactcagtaaaggccagttgtgacgccaacataattggcaataattcaataattagtaacacgaaacgattcataatcataacccctcaatatctatctgtcgtagtaccagtatacaagaaaagacgccctaagatggacgccttttggaaactctttacttcacacccagcacaatcgccgtatacggtggcaattggaaacgatgaccatgttgcgtcaccttacctgctttgcacagcacttcgcccggttgcgtgagtgacacgcggtttggcttctcgctcaagttgatgacaaccgtcaacaagcgtccacccaaacgacgctggtaagtaatgacatcagccggcatccccgacaatgggtagaactcgcctgacacaatcaagtcacgccaaagtggattctggcgcaattgccccagcgcttggtaataatgaagcactgagtctgagttagctagttccgtttgcacatcaacaccgtcacggtcatcccccatcgccaaccaaggcacttggtcagaaaagcccccaaactcatccggcgtccattgcatgggtacacgaccattgtcacgtgacttcttgttaatcacgtctagggcttcagcttcagtcaaaccaccctgcaatgccatctcgtagttgttaattgatgagacatcgttaaagtcatcaatactctcacgattaaagttcttcatgcccagttcttgcccttgataaatcaccggtacccctggcaagaagtagtacatcgtcgccaacgtcttcgctgccgtttccgtacgataagctgcattcgaaatcagctttgacaaaacacgcggttgatcgtggttctccaaaacgttaccgaggtagccatcaatctcatggacctgcttttgcgagttaaacatgcgctcacgcaaatcggtcgtcgtccattctgaacggccacggtaccactcatccgtgttttcaacttcaatgttcatatatgagaagtcaaaaatctttgagaaatagccatctggtccgatgtacttatgcaaatcctcatcaggtacaccatacgcctcaccaattgtgaccgcgtcgtacttggcaaacgtttcggccttcaactcactcaaaaagtcatcgatacccgggcggttttgccccttcttaaggaccgacaccaatccatccggaccgtcacttggcaaacttgcccagtccaaatccttcttcaagtgcgtgatagcatcgatacggaacccggcaacgcccatctccaaccaccaattaatcatgtcgtaaatgtcacgacgcatggctgggttttcccagttcaaatcaggttgctctggcgcaaaactgtggaagtagtacgtgccaggttcaccgggcacttcggtccacgttgacccaccaaacagactacgccaattatttggcacttgcccgtcagccggcgtcttgaaaatgtagtaatcacggtacggactctgcttatccgctaacgctgcctggaaccactcatgttcgtctgatgtgtgattcacgaccaagtccatgataattttcataccacgcttgttagcctcggccaataattctttgaaatcagccatcgagccaaattgtggatcaatatcttgatagtcagagatgtcataccccatatcgaccatcggtgacttgtaaactggtgagacccaaatcatcgtgacccccaaatcacgaatatagtctaatcgtgaaataatgccgcgaatatcgccaatcccgtcgtggtttgaatcttgaaatgaacgtggatagacttgatacacaacttcgtctaaccaccatggttgctctgccataatactattactcccctaaaaaaatagttatttgcaggtttaatataccgaaccgctacgcattcatccaacaaatcaccctcattttatgaaaacgtttgcatttagatttaatccgtgcgaaagttaatgtcataggagggactattgcacatgacattaaacattccaacactgacattaaacgacggtcatccactacccgtactcggacttgggacttaccaaatccgcggtggcgaggggatgcaacaaattttggcagccattcaaagcggttaccgcttgattgactcagctaccaactacgacaacgaaggtatcgtgggcgaagcaattcgtcgctcaggtattccccgctctgaatttttcatcacgtcaaagttgcctggtaagtaccacggctacgaagatgctttgatggcggtgcaagaatcattggcacgtatggggcttgattacttcgacttgttcatcattcactggccattgcctaagcgtgataagtatgttgaagcttggcaagccttggtcacggcgcaaaagcttggtttgattcgctcaatcggtgtctctaattttgaaccagagcaccttgaccgcatcattgctgaaactggcgtgacgccagccgttaaccaaatcgaaatccacccctactgggtacaagagcaaaacctactcgaaaacgagaagcgtggtattttggttgaggcttggagtccacttggtcgtggtagcgcgtcaatgcgtgaacaagttgtgattgatatcgccaacaagtatggtaagactccaagtcaaatcatcacccgttggcatattgaccgtggcatcgtgccaatcttgcgttcaacgaaccctgtgcaccaacgcgaaaacgctgcggtgttcgattttgcgttgaccactgatgaaatcgctgcgattaacgggttgaataagcctgacggtcgcattgatggccaagatccaaacgaatacgaagaatttgaataacaaacaagccgacctggttataaatcaggtcggcttgttttatttctttaagatatctgcgaaacgtttttgtagcgcgggcacgacgtccgtttcaaaccacggattcttggcaagccagatgttgttgagtggggatgggtgcgccaacggcaaataccgtgacccaaaatccgtgaatcgatgcaccacactggttaacgattcactcgctttgattggcaaataatgctgttgcgcatactttccgactagcaaaatcaattcgacatccggcatcgtatcaagtagtcgttggtgccattcacccgccacaaatttgcgtggtggtaaatcaccactcttccccttgcctggaaaatagaaatccatcggcagcacgccaattaaaccagagtcgtagaaggttgtccggtcgatgcccatccactcacgtaatcgatcaccacttttatcattgaacgaaatcccagtttgctcaacaactgtgcccggcgcttggctaataatcaatattttcacagttggcgcaatcatataaattggctcaagtccgcgctctgtaaacgacgcattacgtggatcagccattatttcctgttttaaatccacaaccattacctccaaaaaaatcggtactacatcaattgtagtaccgattcatattaactgtgtttagaaactaaacttgttagcattatcttccttaatgtagattgacttcaatccttcgccttcaaggaactcacggaatggcacaagcgcttcagcttcgtacttttccttgtatgccttgacgacgtcttcgctgtacaagtttgtatcaagcttcaacgtttcaactggaattggacggtccttggtaatcttcgcatccacaacgacaacgcgaccttgcttgtagtaatcaactgcttcttgcataacgcggtcaatgtcttcaatgcggttgactgtcaaaccaatggcaccttgggcttcaccaaccttggcgtaatcaacatctgtaaagtcgaccccgaagttgtactcgttagtgtcttcatacttgttcttgatgaaaccgtactcggtgtttgtaaagataacgttaatcattggcatgtcataacgcacgctcgtaacaacatcaggatacgtcattgagaacgcaccatcaccgatgatgttccaaacttgacggtctggataaatgttcttcgcaccaataccacctggcaaagcaattcccatcgttgcaaataatggtgatgtacgccacatttgcttagggttcatgtgcaagtgacgcgttgacaattgcgttacgtcaccgacatcagttgagaagatggcatcttcatcagccaacttgttgatggcattgtagacttggtaggcttgcaaaggtccttctgtcttttgctccaacttgttcatgtagtcgcgccagttttggacattcttgatgttcgcttgccaccatggtgtatcagctactggttcaaccttggccaacaacgccttcaatgattcacccgcatcagccaagattgcgacatccgtttcgtgacgcttaccaagcatatctgggttcgcatcgatttgaatgaacttcttcacgttacggaacgttccctcaacttctgagaatgggaagttcgttccaatgaacaataccgtatcggcctccaaaacagcttcattagctggcttccaaccaacacggaacgctgaaccagtcaatgcttcaaagtcccagttaaagttatcgaagttctttccagtcgtaatgactggcgccttaatcttgcgtgatagttcctcaactaaatcaccgtgaccttgtgttccgaaaccggcgtagataactggacgttctgaagccttcaaaatttcgactgcttcatcgatttcttccgcttcaggcgctactggcttgtagcgcttgtacttagtccctgaagagtacaaaggtgttgagtaaattgactcagcatccaactcagcgaaaccaaagtcagctggtacttcaagcactgccacaccgcgctttgaaatggcggtacgaattgcatcgtccaccaagtgaggcaattgctcagccgtcgctacacgacggttgtacaccgcaatgtggtcgtacattggattttggttcaattcttggaatgaatccatgttcaattcacgcactggctttgatcccaaaatggctagcacggggatgtgatccatgtacgcatcgtacaacccgttaatcaagtgcgtagcacctggtccaccagacccaaccgttaccgcaatatttcccccgaacttatattgcataaccgcagccatcgcaccaatttcttcgtgcttaacttggataaacttcaccttgttttctggatttcccatcgcattcatcaaaccacttagcgtaccagaaggaataccatacatggtatcaatcccccagccttccatgaccttcaatgctgctaatccggcagaaatcttcttatctgacatctttcataaacccccatacgcatattcttgtaagcgctttcttgagtttattctagtcttttaatttatacaaagtcaaattatatatttcaacggcgcgttaaatttcatgcaatacagccattgttatcaatgatacttcccccaccaagtaataccaagccagccaatagtcaatccagacacaatgctacccacagccgcgacaacaatcttctctgtcgagttttgtggttcagcttcagttggtgctggctgtgatttcgtaacaacagttggttcttttaccgtttgcggaattgtcgccgcttgtatagccggcttgtcatcagctttcgtcaccacagccggcgccttgcttgctacgactcctgccgcaacgattggtgcctgtgtgaccagattttctgatttggttgcctgcgttactttcacaggtgtagttctaaccacctgtgctttaatttgcttttggggtgcttccggtcgcataatcccttcagttaacttcactaccgttgtatcccccacaggtgtctccttaaccggtggtagtgacacagcgcctggcatgccttctaatcggaaagtcacgtcataccaattgtcgtagacaaaacttcccgttcgaaaatcgacgtgcatattttcaatgaacagcggcttcgcaacttgctcagcggttaaatcgaattcgtaggtcataatatattcagatccaaccagattagctgataattgtcgcccactcgtaaacgtaatgctgttaggaccgtaatcggctggcactttagccgtaatcgtcaaaatacccgtgccgtctttaccaggctcgaacgttgctgccgagttaatgtagttacttgccacagaggtcaagttgctaccatcccccttcaacacggccaacgtcaccggcaaacgactcgattgcgcaacttccgttttaaccgtgaacggttgttctactgtgccactaaaacgtttgttaataccacttgctgccttgttatcccaagaaaaataagtagaactatctggtttaaccccttgcaacgtcacctgaccatttaccgttttaattggcgcaccgtcttgttgcaagtcaattgcgttacccgccgtgtctttgactgacaatggcactgttgctgttgtctcaccgttcttcaatccaatggctgcattggtgactgattgaaatttcgcattcagataagacagatcctgtaagttttgcaacgggctcaaatctgaaacgtggttacgcaacatattcaacgacgtcagcttcgttaatcctgccagcggcgccaaatttgcaacttgtgcatttgaaaaactcaggtcagtcaaatttgtcatctgcttcagtggtgttaaatcagcgactcggtccttgctaaagttcaaactttgcaactggcgcaatccagccaatggcgttaaatcagaaatttgatcgttaaaatcaattgataacgtcaccagcttcggcatgtaagaaaagatttgtaccgcattattcgttagccccatttgtgaaaatgttgcttcttccagatttaccaacgaccgtagcattgaaatatcgttactgcggttattcccaatcgacaacgttgttaggttcgtcagtgatgcaatcggcgtgtaatcggttagctgatttgatcctaccttcagctcggtcagttgtcgcatccccgccaatgcttgaacagaggtcaacttattaccagcaagtcccagatacctcagtttgggcaatcccgtcaccggtggtaccgtggtcaaatcattgttctgcatttctaattcttcaagcgacgttaattgtgccaacccagccatcttgtctggctgcgtgccataatcatccgcaaccaaattcaacgacttaactggcgtaccagctaacagactcaaatccggcataatctttgctttattcattcgcaaactaaggttggtcaggttgtgcaaattctgcaacggtgtaatatccgcgatagtattgcctgttaaatcaagcgcctgcaagttggttgcaaactcaagccccgttaaatcagtaatgccatcatacgttaaattaagttgcgtaattgtcgcaacatttgccttcgtcaaaggcgtccctttacccaaggcagcttgcagtgccccacgcaatgctgcatcaggcacccaacttgcgacatcatcagttgctgtgtttgctaatgttgtgtccgcctgcaccggcatattacttgtggttatcccaacaatgctaccaagcagtatcccactaataacaacagcatgttttattcgttcgattgttccttaccttcacattcccataaacttattctgcgtaagtccagtttactggaatgtgagatgctgaacaaaaccaatttttaacgtcacgtaaaacgttgcccgaagtttgggacaaaaatagccgttcgaatcatcggactcgaacggctaaagcaattaataacgtttcagaagttgtgcaacaccgattgccaaaataccaatcagtgccccaaaaataggaagtgtttgtagtcccgcatgtaccatcaccatgttaccgacaaacgatccgccggcaataccgaagttcaatgccgacacattcagcgcagaagcgacatcagtatgcgctggcgctaattcagtagtcgtgatgataatgcgactttgcaatgatgcattacccatgaacgccactaacccaagtagtgcaacaccaagcaaataccagccagccttaggcagtaatgccaattggatgctttgaacgaccgcttgcgctaagaacacgcccatcagaatgtgtagtgactggcggttagctaatcgaccaccaatcacatttccaattgtgacaaagacaccatacaatactagcacccaaacaacactagtcgttgaaatgcccgttacttgttggagatatgggcgaatgtacgtgtacaacacaaaggtcgccccgaacccaagcgttgccatcaagagtgttagcgaaattcgtggttgtcgaataacggtaagaattcccaacaattgattgtccgtaacagtcggcgctgccgactttggcacttggattaacacacccagccaaccaattaagcccatgatgccgaccaccgcaaaagttgcacgccagccgacgacatcacctaagtacgtgccaaatggtacaccaaagacagttgcaacagtcagaccgccaaataaccacgacgctgcttcgccttttttatctagtggtgccatgtttgttagatacactgatgctgtcgcaaagaacacaccgtgcacaaccgcagtcaatgcgcgtgtcaccaacaaaagaccgtacgaaggcgcgatagcagaagcgacattcaatactgcaaacgcaaacatcaaccacgtaaacaagcgacgccgagctacccggccaacaaaactcgttgcgattggtgcgccgacagcctgtgcaatcgcatagccagttactaacaagccaatcatccccgtcgagacgtgcatatccttagcaatatctgtcagcatccctactggcacaaattcagtggttccaattgcaaaggtcgaaacagccaacgcaatcgcaattttataatatttagtcatctcaaaaacacctcacataaagtagactggaaatgtcggaggtttaaaacctccgacgtgaccaagtcgcccttatcaggtgcgtacttggtcttgattcctggctaaggccaggggtcttagaccaatagttgctgtggtaaagtaaccactttaccgcattttccagcacaacaccactctgcaaaaaaaaaagacagcattcacaactgtcttttctcgtaaatcttaaatcgtcactaactgaccagatccattcgtcgcatcaaacacatacgtttggtgcgtctcttgattggttgcttgaccaccctttaattgtgaaccatcagcaccaaagtaacgtagttcaccgttaatcgtttgcaaaccagtcaccatgcgaccattctcgtcaaagtaataccacttgccattgtgataagcataatcatttttgacctcagcgccgttggttccgttgaagtagtgcaccccatcagcatcataaacaaagtcatccttcacttggtgattttgatcatcgaagtacagcgtatcttggttaattgtcgtcatgccacgtgccagattaccattttggtcagcgtacaaccagtggccatctgtatccaaaataaattggcgcttaatcatatttccattaccagccgcatagtaatgagcctgaccgttggcatcacgcactaattgggccttcgcttggacaccattcgaaccaaagtattgatcattaccatcaaccgtcaaagcttggcttcgaatcacattcccatcagcatccacgcggaatgcatttgcttggtgatcagtcacatattgattaacgaccagcttaccgttcttatcgtagtattgcatgttcccatcttcagcctcaacaaacgcatccgtcaacgcaataccatttggcaagaagaagtattgactaccatggcgggtttgcttgcctgtgaccattacaccattctcatcaaagtagtacaactcaccattgtcatccttgataaacgcatctgttgccgctgacccgctcagtgtttcgaagtgataaccatccgctaacttgtggaaaccagtcatcacaggcttgcctagcatttggttcggcaaattcgtgttacccgtattagccgttacgcgataatagctattattacctgcgtcacgtagcacatagcccgcgccacggccttggattgccgtaccattaagatacttagcggaccattctttaatcttcactgagtcatcaatcggcttacccgttgaaacttggtttgtcgtaaacaaatcagggtacaattcacgcaacttagtcaagaactcaccaccatattgcttttggtactcaccaccaccacgagtgcttgtgacatacatcaagtgttggatttctgaattcttgtctggttcacccatattattcgttcgagttacttgaaccaattccttgcctggcaaggcgtaaagctggtccggcacaaagtcagccatcacttgaataccatttgcgtggagtgccttaatcacatcacgcaaattattgtcatcaccgtacttagttggcgttccaaatcccaggtcatagcggtccgtaaaggcatatccgttttgaataattgaatccaagaatgtgccgtccgttgatgaacgatattgtggtgccaattgaactgatgttacgccccaatcagtcaacagatcggcatgcttagccaaaacgacatttgtgtattcatcgtgagtcgttggcatcgcttggaagtttgagaatccttcaaaaatcacctggctatctagcgcagcatttgaatggtaagctgatccatcagtcgtcgcttcggtgcttgcagctgttcgggcatcttgtgttgcgctagcgccaacgggtacccacattgccaagaaccctgatacttgtggattcaggacaccgtaaacgtctttgtttgtgaaaatcaaatcaccattcgcatccgtgtaacgaattggcgcgttatcatcgttgtaaactgccaaaccagttgccgttgtcataataacggcacggaatgcttggttcgcgtgcgcgattcccatgtgcaaaacaacctggtcactatcagccatcttcaaatcgtgattattactgataatcaatccgacaccttccgtacgggtttcagcggttccagcatcgttaaccgtcatcgcccccttaccaaaacgaacactcgtcaggacatcattcttgtcgaccgccatggtttgtccaccagccacatacttggtacgtgctttcaacaaggcatcaatggcatcaaagtatggtgacttagtagccatgtattgaccatcgtctgtgtacaaatcaccatagtacacgcgtggaatcacatctttattcgtcagcaacatcgcgtaagcagacggcatgttgtagtgcgtgtattccttaaccgccttcttttgatcagcattgtaaatcttaaacgcttcatccatctgagcctgggtcggcatcaacccattaccggcttcagggtgcaacttagtcacaatttcagcaatcaccgtttgtacttcactgtcgtgagcacgcacaaacgagtaactaggctgagcttcgttttcagtgttgtcattagcgcgatttgttaagtagaaatccaagaagcgatccatcttgccacgttgtgcatctgactttgttaatgaccaaatcaattgggtatgcatgtaatcatccatcgtcaattggtcgttaccgtggtcattcatgtaggctgggtcgttatgactccaatcttccaaaattgacaagtgctgatttgatgttgcatcatttgtcgccataccgtacgcttcacggaaatattgtgcggccaattgcaataggtcagcatcaacgttatcgacagcgtcaacacgaatggcatcaaaattagcatccggatcgttagccgtgattgaaccaaaattcatcaaatagtatagccagttaagttgctcagcttgtacctgtggatttgagttatccacgtcattggctaatagtaattcgtagccacccaacgaatcatcaatgtggtacaaacggtcgccagtttgattagttggcgtacggttcatcaaacggtaatcggagttagcatctgtatctgaattattttcaaatgacagcgcaccaccttgtaagtgatcatcattttcgtcttcactactcttattccattgcggttgcgtggcaacgaatgctgccatcaattcatgtagccagtccgttgattgcttgaccgtaatctgacgctcaatagccgcttgaatggcatcagctgcagcggttagggtagcttccgaatcggctgcacttacagacttagttgatacctgcaaggcatcattcatgtaattcacataatctgcttgtgtttgcttcgttggccaccacgtttcaatcaatggacggtactcggtcggcgtcgattcacgccacgttacaccgttatccaaaatatcatttggacgataccatgtatcagctgtcaaatagcccgccatgttgtcaaagtcttcaggcgttgtcccatgcgctgcattgtgttgtgcattctcagttggtaccggttccaattcagggctaaatgtaggatcagacgtcggtgtcgccacacctgtctgatcatcaaagtacatcatcgtaccgtttacttctgccgcaagaccttttagcatgcgaccttggtcatcgaaattatacgtttggccatcaattacttgaatacccgtgacgcaattcccgtcgttatcaaaatagtacgtgtctcggtttgatgtttgaccaaaaccatttgtgatttcatagccgtcggcatcaaagccacgcacaaccccgtcgactacttgcgtctcagttagtgcacgtccttcttgaccatcgtagtaagcttgcttgccatcagtttctcgccaatcacctttcacttggtggccatctttgtcgaagtagacgttaaacgtgtcaatcagttggcgtcccgttagctttttaccgttacggtagtaaacccagttgacaccttcatcatgataaccatcagtggtagttgcggcgattgatgctgacgccgaactagcggcagacaacatcgtggcggagcttgctactgatgatgacactgaactagtttgtgatgatacctcactagccgatgatgatatggccacattgttactatcaactgacgccatcgatgactgtccaaccactgtagaatcactcagactagtaacactatcaggtgcctgactatctgttgtcgtttcattctgtgtgacctcgaccgattccgtcggctgcaggtttgtttgatcagcttgaaccggtccagccataatcatcccgataaacatggcaccggctgctacccaaaacttacctgccttgtacatcttttttctaaacttcgttgtgtcgtattccaaaacaatgtccccatattctatttgataatccccaaggccttggttctagggatagaccttaacgccaaatcaaataccctgtcaattttttcacaagttgaagatagaccactcccatttcatttatatcgttaaccaatatctaatgaaaaactactcacccttaattctagcaatctcaacccacatgcatcttgagttattaattacaaattaattggttttgtattttttatttatttttaaaacattcatcaagttcacaaacaaaacaaaaaaagtgatgacaactcatttgccgtcaccacttcctacgtcattggttttacttaattcgaccgccaataattggcacgttcttcaagccatctgttccaaccaaagccagaacgaagataactgcactcacggcgtagtgaacccaagttacactgtggccgaatggcataagcgacaaccctagtaccacaacaatcatcttccagccccaataattgaggccgatgtcgttgaaacgtcgtaccatcaatgaaagtgatggtactgcaatggcaagtactgataccaagaacaatacgccaacagcagtaagacctgtgttatctacactcgctgatagatgtaccaataagttgttgctgaatagtgccaaaagcaacgcaatcattccaagccaaacagcctgccacaacacattcaagaaataatccttacgtgttgtgcgacccttaaagtcaaagatgtgcttccaaaacccttggaatgctgctgtcatagtcgtcattgttaaacccctccaacaatctaaaaacgaatagttttgatcatcaaggtggaaactcccttatctccatctgacacagtaagtatattccttcacaattagtcccccaaataataagtcttatatttcagacttttcatgttttcatgataatcgccaagaatgcaacaaaaaaacgcgttcgcaatcgaaattgcaaacgcgttttttgtttttggattcgtttccaatccagaaagtgaaaatcgaaagattaacgctttgagaattgtgaagccttacgggccttcttcaaacctggcttcttacgctccttcatacgagcgtcacgagtcaacaatccagccttcttcaaagctgcacggaagtcaggatccacttgcaacaaagcacgtgagataccgtgacggatggcaccagattgacctgagaaaccaccaccgtttacgttaaccaaaacatcgtagtttcctagagtttcagtaacgttgaatggttgtaccataacctcacgcaagttagcgaaaggaatgtattgttcagctgaacgaccgttgatcgtgattgcaccgttaccaggtaccaaacgtacgcgggcaacagagttcttacgacggccagttccgtagtattgtacttgagccataattaactattctcctttcgttaaattaaataaggttagtgatatccaacacttcagggttttgtgctgcgtgtgtgtgctctgaaccagcaaacacgtgcaacttcaaaccttgttggcgaccaagagtaccctttggcaacatgccgtgaactgaaagctcgatcaaacgttgtgggttcttctctcgcaagtcaccagcttgacgctccttcaaaccacctgggtggtttgagtggtggtagtaaatcttgtccgtagccttcttacccgtcaaagcgaccttttcggcgttgataacgataacgttatcaccagtgtcgacgttaggcgtgaaagtaggcttgttcttaccacgcaagattgatgctacgacagttgacaaacgtcccaatgcaatatcagttgcatcgatgacgtaccacttgcgatcgatctcacctggctttgccatataagttgtacgcatggaaaattcctccaatattctgtttgtttactttaccaataattaaaaaagtcgtaccaggacattcccattgcggtgtggtaaacaataccgagatttatcttaccttttttctgaccaaacgtcaacggcaatagccctcggatttagcaaattcgttagtttttggccaatctgattaataatcaaccgacatcaagtaaagaccttgagctggggccgtgaatcgcgcttgttgacgatccttcaccgcaaataagcgttgaatatcatccaccggccgtgagccattaccaatctccaacaacacgccgaccatgatacgaatttgattgtacaagaacccattacctgagaactcaaaccaaatttcatcttcttccggcttctcccacatcttagcggagtaaaccgtgcggactgtcgttttttgttggaaccccgaggccacaaaactcaaccaatcatgttcaccaacataatcgccgatggcttgctgcatcaagctcgtatcgatacgacggtgccagtgaccagtgtagttacgcttaaacggatcgatgaattcagtcgttgaaagacgatataggtacgtcttgttgtgggcgctaaattgtgcgtggaaagactcatccaccttttcaactgacttgataccaatgtcataagggagcatcgttgaaagccccttacgcaccgcctcattcggaatatcaaaaggcaaatcaaaatgtacgacttgccccttggcgtgaacgcgcgcatcagtacgccctgatccttggacacgaatatgctcggtcggatctttagccatcttgttaacgactttttccatctcaagttgcacagttcgcttgccaggctgaacctgccaaccataaaattctgtgccatcatacgaaattgttgctttgtatcgtggcatctcttctcttctttctaaatccagcgcgttgcaattaagacaacggcaaatacgataaatccaatgactgcaaccgtatcttgcttgccccaagtcaaaacacggtacttcgttcggtgatcaccaccacggtaaccacgggcttccatggcatccccaagttcaattgcgcgcttaatcgcattaatgaacaatggaattagcaatggtacaaacgccttaatgcgactaacgatgttaccttcgttaaactcgacgccacgcgcacgttgcgcattcataatcgtctcagcttcatccatcaacgttggcacaaaacgcagtgcaattgatagcatcaacgccaattcagcaacggggaagcctaccttcttcaaaggtgccagcaaattctccattgcgtccgcaactgctagtggttgtgttgtgagtgtcaaaatggttgaaaacatgataatcaagacgaaacgcacgaacacttcgatactgttaatcacaccgtccgtggtaatcgtgataatccaccagtgccagagcacgtgaccagtttgaacaaagaataattgcaaaagcgttgtgataaacatcaagaacaacaatggtcgtacaccgcgcaagaagacacccacacccaatccagttagggtaatggccatcaatgtgaagattgctgccacaacatagccagccacattattggcaaagaaaatcacaaaaataaacgcgatacttaagactaactttgtgcgggcatccaaacggtgaacccatgattcacctggcatataacgtccaatcaagaggttattaaacatgcgcttcccctcctaattttgtggccaattgatcagccaattggtcaatatccaagacattctcaagttgcaaccccttatcagcaagttgatctgcaaactgcttagcaatcggcacatcaagctgcttttcatgaagccaatcaacatccgcaaagacttcagtcggcgtcccttccttcacgacagttccaccttcaaaaatgaccacgtgatcagcgtactgggcaacatactccatctggtgcgtaatcaaaataaccgtcatgtcacgttccttttgcaaacgcacaaacaacgtcatcagctcttcttgcccggctggatctagtccggccgttggctcatcaagaatcaacaagtccggttccattgccaaaacgccagcaatggcgacacgtcgcatttgaccaccagacaattcaaacggtgaacgctcatcgaatcgttcagccatccccaccgtacgtaaggcacgttgggcagcttctttcgcttcagcttccgacttaccaaagttctttgggccgaacattacgtctttcaagacggtttgttcaaacaattgcgcttcagggaattggaaaacaagtcctacgtgagcacgcatttggttcagctctttcggctttgttgttggcacgatgcgctgttcaccaatcgtaatttcaccagccgttggaattaccaagccgtctaagtgttgcaccatggtcgacttacctgaaccagtgtgaccaattaccgccgtaaactttccttctggcatggtgaagttaacatcatgcaaaccaggcgtcgcgaatggcgtgtttaattggtacgtaaaacctacttggttgaaattgattgccatagccaatccaccatcccttcagtcgttaagtatgagtcgggaacatcaattccacgttcacgcaacttttcctttagttgttctgcaaaaggcaccgccaaaccgaattcacgcaacttttcagcgttggcaaaaacatcctctggcgtacccgtttgcatcaaatcaccgtcgttaatcacgacaacgcggtcagcgctcgccgcttcttcgatatcgtgggtgattgaaataaccgtcaatgcatcaccaagttgacgcttcaaatcatgtaccagtgcaatcatttcgcgacgacccttgggatcaagcatggctgttgcttcgtccagaattaagatttgtggttgaatcgcaagaacggatgcaatcgcaacgcgttgcttttgacccccagataggcgcgctggttcgcgatccgcgaacttagccatgccaaccttctcaagcgcttccgcgacacgtggcaccatctcctcgcgtggaatcccacggttttccatcccaaatgcgacatcatcagccaccgttgcgccgacaaattgattatctggattttgaaagaccatccccacaaggtcgtgaatcgtccacatattatcttcgttaactggcgtaccggcaatcgtaatttcacctgccgttggcgccaacaaatagttcaatagttttgctaaggtcgacttacccgacccattatgtccaataattgcaatccactcgccttgattaatcgttaatgagagatcgttcaaggctggtgtctcgctgtttggatatgagtacgtcacatgcgacaactcgataatttgcgtcacgttcacgcccccttacttattttttgctacttaccataataccaaactcgacctatgttttgtggcgtttggtgcaatttgtcgggtacaatagttttgagaggatttacatatgtcagatatcgatttaagtcgctcagccgactaccgtaacgtcacggacttttttaaaggtcactctgatgacgaaataaaagccgccttagacgaacgtcgtggcgacatgattaccatcatgcaaaacctaagtcatgatttcaacaaagcatctgccgtacgtaacagcaatgcgtttggtatgcgcaaaatcattttcctaaaccccgaaaacccagcgattcctgattcaaccgaaggcatcaagaaatgggatcgtcgtgggtcactaggcacccaaaactacgaacacattgagcatcaccgtgtgaccgactatcaagctttgtttgataacttacacacagatggttataccatttacgccgtggataatacacctggctacgatccgcaatcagtgtatgatgtgcaattcccaacgaagtctgctttcctatttggtgaagaaaaacttggcttagcagatgacttaattgccgcagctgatgccatgatttacatcccacagtatggtagcgtgcgttcaattaacgtcagtgtcgcccatggtattatttcagcattctatgcttcacagcatatgtaaaagagagcacgatgaatttactcatcgtgctctcttttcgtttactattacttcttcaagtcgttgtaacgtgactcgtgcttaccgtacaagctacgtccaagcgtcttctccaagaatggtgttacccagtagtccaaaccgaacgtgcgacctgaaccgttcataacagccaatgaagcgaacgtcaacaaaaccattgacgttgtcgctgaaccagcaaaaatcaataccaagcccaacacaaaggcaacgaaaccagcaattgacgtcaaaagaccaaaggcaatcaaccaaccaacaaccgtggcaatcataccaatcgtgcctgaaactgatgaacccgcagaaatccacaagataccaacaacaatacgtagtggcacagtccacaaaacgttacccatacgtgacgtccaaccgtagaatggcgtacgaccatttggcgtacggaagaactcgtccatcaagtagtggaagatgtggtaaccactcgtgatttgcgcaaagaagtacaagttaatcacgtgcttgaacatgttggcaaagaagccagacaatggcaaaccgttcttaccaagctttacgctaccaagttgctcagcgattccaaccgtgtagtgtgcaccgattgaaacagcatatccttggtagtgacccttaaaggccttacgtgaacccttacccaacaaatcgaagatgatgttaggaacagccgtgttagcagctgattctccaccttcaaccgtttgtggcgtccaacctgaacgtgggttgtcaggaatcgtacgagcaggctcttggtaggccgcaacgtcaccaacaacataaatgtcttcctcacccttggcgcgtgagtagtcatcggccataaagcgaccagcaggtccttgttccaagccccactttgagccttgctcctttgccttaacaccagccgtccaaaccaatgtttcagtaggaatttccgtaccgtccttcaaaacggcagcgtgttccttaacctcaacaacaccagcagacttgcgcatgttaacgccgtgcttgatcatgtattgctcgcccttgtcagcaagcttacggttcgtcaacatgttcaaaattgttggtgcagcttcgatcacgtcaatcttaatttctgattcgtccaagttgttagcttcagcaagctcacgacgttgctcaatcaattcaccggccaattcaacacccgtaaatcctgaaccaacaaccgcaatgcgcaacttagcttcgcgctttgcaggatccaactccatggcaccttcacgaatgacttcttcgatgtgcgcacgtaggcgaaccgcttcttcaaatgaccacaacgtgtagccgtactcctcaacacctggcgtaccaaatgtattagtcgtaccaccagttgccaagaccaacttctcgtaaggaatatctccttcagaagtcttaacaatctttgcttccttgtcaatcgtatcaaccgtggcagtcacaatcttaacgtttggttggcgcacgaacaacgtacgcaaatcaaattggatgtgctttggctcaacacgcttcgttgcaacttcatgcaactccgtcatgtacgtaaagaatgaatggcggtctaccaaaacaatttggtaatccgtgcccttcaatcgcttagccaacttgcgcgcagtaaatacaccagaataaccggcacccactacgacgatgtttttattagccatatgaaaaaatctcctcagtatcccacaaaaaatgtaattaaaaataaatcctcaaataattttagacctgcaaagtggatttgtaaatgaattcactatttttttgtaaataaaaaatccgctatatcacgcctttcacagacattataccaatcaatcccttgttattcgtgcatttatgctcaactatttgtgcgaaatataatacttttaatagcttctttaaggtacaaagacgtgtcccgaaaaacgggacacgtctttgttttttaattattcaaccatcataccagcatgaatcttatcgatattccacttaaccatgtcgtagtaagtgtcaccctgtgttcccttcttagccaaagaatccgtataaatcttttcgtagattggcaaaccagtttccttagaaaccttctccattgacttaggtgaaacagaacttgctcttatgctagatttacggacagatttttctctgccctgtaaactaatagtagaggagcattttttatatgattcgatattcaccagaatttaagcaatctcttgtcgagatgcacaaccaagggcgttcttgaacacagaagttaagctcaatagcgccgaaagtagttggaggatcgcttcctgcgaggataggacgtcgcgatgcacatggacgtttagctcagctgggagagcacctgccttacaagcagggggtcacaggttcgatccctgtaacgtccatcctaaccaccagttacctggtggtttttttgtgccatcaattatcacaatttacacacaaagttcatttattctggaaattgcgcataagacgggcgttctttctgatataatagttcttagttagtttttatttaccgctttagttagcgggtgaaaatagtatgctagcacatttaacagatgtgtcaggaaggaagtcgaaacatgtcagattatgctgtgaagtacgaattgcttcacgttgaaaagcatactggtgcacgtttgggtaagattacgacaccacacggtgaagtaatgaccccaatgttcatgccagttggtacacaagcgaccgttaaaaatgtctcaccacgcgaattgaaggagattaagtctcaattcattttgtctaacacttaccacttgtgggtacgtcctggtgatgagttgattgctgaagctggtggtttgcacaagtttatgaattgggatggcccaattttgactgattctggtggtttccaagtttggtcattgtcagagcgtaacaacattaaggaagagggtgtcactttccgtaaccacgtgaatggtgaagaaatgttcctttctccagaagttgcgatgcgaatccaaaataacttgggttctgacgtgatgatgcaattggatgaagcgattccatacttcgaaacgtatgattacgtgaagaactcagttgagcgtacatcacgctgggctgagcgtgctatggcagcacaccgtcgtccggagaatcaagcgttgtttggtatcgtacaaggtgctggattccgtgagctacgtaagcaatcagctcgtgacttggtttcacttgatttacctggttatgccgtaggtggtttgtcagttggtgaaacgaaggaagaaatgaaccgtgtgctagacttcacggtgccattcttgcctgagaataagccacgctacttgatgggtgtggcggcacctgactcattgattgacggtgccatccgtggtatcgacatgtttgattcggttttgccaacgcgtatcgctcgtaagggaacgttgatgacatctaagggtcgtatcgtgattacgaactcaaagtacaagaatgatttttctttgattgaccctgagacggaagactacggttcacaaaactttacgaaggcatacttgcaccacttgtttaaggctgatgagttgtatgcacaaaacatcgcctcagtgcacaatttgcgttacttgttgaagctcatggaagacatgcgccaagcaattgcggaagatcgactacttgagttccgtgaagaggttatggccaactacggttataacaacgcaaatgcccgtctgttctaattactgttattaaaattttaggagatttactactatgtcaatgaacattttgattttgattgtcttcgtggcagctatgtactttatcatgattcgcccacaacaaaaggcgcaaaagacgcgtcaagagatgatcaacaacgtacaaccaggtgccgaagtggttactatcggtggtttgcacggtaagattgctggtgttaacaaggaagctaagactttcgatttggatgctgaaggtgttatcttggtattcgagttgtcagctatccgccaagttgttaaggctgctgagagtaagactgaagctgttgaagcaccagttgctgaagaagttaaggctgaagagccagcttcagaagacgaaaagtaattttttagaattcgagttgcaatgcgcaacttgaattctttttattagctggcaagaaaggaggttatcatggctgatttgctagagataccagtgcatttaaaaacagatcgacaaattattcacgtggatatggatgcattttatgcccaagtggaaatccgtgataatcccgcgctggcaaatgtgccattaattctggcgcatgacccgcgtaagaatggtggccgtggtgtggtggcgacagctaactatgttgcgcgaaagttgggcgtgcattcagcaatgagtgcagccgaagcattacgattagcaccgaacgcaacgttcttagaccctaactttgaaaagtaccgtgctgtgtcacagcaagttcatgatatttttcaacgttacacagataaggttgaaccaattgcgtttgatgaggcttatcttgatgttactgagaataaaacggggcataccaatgcagtggcactggcccacgaattacagcaaactatttttgcagaattgtcattgacgagttcagttggtatttcattcaataaattcttagcgaagttatcatctgaacataataagccggttggtctcacggttgtccgtgaggcggatattcgtgcatttttagatgcgctaccaattgaagatgtgcgtggtgtgggacagaaaacggcgataaagatgcacgaacttggtgtggatacggggcgtgacttatacgagatggaccagacaacattgacccagcattttggtcgaatgggctatgatttttatcgtcgtattcgtggtgttgatgatcgcccagttgaatggcagcgtgagcgtaagtcaattggtaaagagcatacgtacgggccattcttagacactgaggagcagattgaggcagagtttaaacgattggccgagcgactagaacagtcacttaaacgacgcggtatgcacggtaaaacactggtcttgaaagtacgtgatgaagattttgatacagagacacgtcgctttactcagacggatttcttaccgaatgacgctacggaatttgtgcgtttggcgcaggacatttgggaagagctaggtgggtatcaaaagccgattcgcttgcttgggttaacgatgaccaacttagcgccactgacctttgaaaatattccactgaatctgtatgataactaactacaacgcgtttttacggccattttctgctatactaataaaagcaacgtaagtaaactagatagaatagagaaagcaacatgacagcgcaaacagcaattttagcgcaaattaaggcggcggatacgattattattcaccgtcatcaacgtccagaccctgacgcatttggttcacaacttggtcttgctgaattgattaagacatcattcccgaataagcatgtccatgttgtgggtaagcaagtgcctagctcagcttggatgggtgagatggaagatattccagattcactttatgataacgccttagttattgttaccgatacggctaatgaaccacgtattgatgaccgccgttttgattacggtaagacgttagttaagattgaccaccaccctaatgaagacccatatgcagattttaattgggttgaagagggtgcgtcatcaacatcagctttgatttacgccttctacaaggaatttgaagacgaattgaagttgtctgatgcgggtgcgtcatatttgtatgctggaattgtcggcgatacaggccgctttttgtatgcaacgaagtctgaaacgatgcaggttgtggcagatttgatgaaatacgattttgattggttcgagattaaccaacgcatggatacgatttcacttgaagctgcccgtgcatcagcttacgtttatagcaatatggtcatgactgaaaatggctttaactatattattttgacgaatgaagtcgtagagagtttcgatcttggcgaatttggtaccgcatttatcgtgccattgctaggaaagattaacacggcgaaggcctgggctgtttttgagcagcaagatgaagggtacttccgcgtacgactccgttcacgtaacacggtggttaacgaaattgctaagcgtcacggcggtggtggacacaagtttgcctcaggtgccttagcaaaggatatggatgaaattaacgatatcattcgtgaagccgatcaaacattgaaggagcaaacagaagcataatggcgaagtttactgactacaacctacgatcagaaatttacacagcgttggaagaaattcgtttcacaacgcctactaaggtgcaagaacgcttgattccagttgtcatgcaaggacgttcagtcgttggacaatcacaaacgggatctggtaagacacacacatttttgattcctattttccaaaagtacgacccatcagttcaaaaggtgcaagccgttattacaacgccttcacgtgaattggcacaacaaatctatgcagcggctaagcaattgggaactggtttcccagttgatcaacaaccacgcattggtttgtacgttggtggtactgacaaggcgcgtcaattgcaccaattggaaagctcacaaccacaaattgttatcggaacacctggtcgtatcaaggacttgtatacggctggtgcattggatatccacacggctgacacattggttgtcgacgaagcggatatgacgatggacttgggattcttgcctgaagttgacgcgattgctggtgcgatgccagaagatttgcaaatgttggtcttctcagcaacgattccacaaaagttgcaaccattcttgaagaagtacctaacgaacccagttattgaagaaatcccaacggaaacggttatcgccccaactatcacgaacttgttggttggtacgaagggaatgaagaaggacgacttggtatacgagttgttgacgatgggtaacccatacatggctttggtcttcacaaacacgaaggaacgtgcccgtgagttgacgaaggctttgcgtaaccgtggtttgaaggttgctgaaattcacggtggtatccaaccacgtgaacgtaagcgtaccatgcaacaaatccaacacttggattaccaatacgtcgtagccactgacttggctgcccgtggtatcgatattcctggtgtgtcattgattatcaacgatggtattccaactgaattggagttcttcgtgcaccgtgttggtcgtactggccgtaacggtatggaaggaactgcgattacgatttacaaccctgatgaggaagatcgcgtgcaagcggttgaagccatgggtgttgaattcgagccgatgacgtactcacacggtgagttgaagcctggttacgaccgtcgccgtcgtaagcaacgttcaaagtcaacggttaagcttgacccaacgatgattggaatggtcaagaagaagaagaagaacgttaagcctggttacaagcgtcaaattaaggcagcgattgcccgcgacgcaaagtacaagaagcgtgtcgaagagcgtcaatcactccgcgctgcgaaaaaggcgaagaagaaggcgaacgagaagtaagtttttatagttaaaaacaggttcacacttagagtgtggacctgttttttggttaataatcaatattgagttggttcaaggacctgttttagtgccacattgagttgttcatagtctgcaagtgagaactcaagatatattttttctaagtactgaccatgtccatcatcgcggtatacaacctgcatatgatagattgggccgtttacctggctaatgtagttattaattgcctgtagtaaatcgaatccttgaaaataattatctctagcaaataaacgagagatatgaacgaattgagaatcatttaatttgactatccgaactgtatttgtggggatgttgttcatttcttgatagctagttatcaatgatttgaaataatccatctaaatgactccttataggtcgtaataaaatataagcaactatcattttgagtccttagaagccagtacaacaatgacaataattgcaattgcagacgttgacttaaccaaaaagtgccatattgaaggccaggcagggtttataaaaatatcgattaggaaatcgaaaaccaatattaatgcccaaaataagatgggtctcattattttgcccctttagttatgtgatattctttgtacatattaccgattaggacgccaacccaaaatacgagtaaatagattttgcggcagttagttaactcggttatgcctgggaaaaagagacccaaaatcagcattgctaaaaacaaagtacccatgactgttgcgcttttacgtaaactgtatataaaccacatctaacgactcctttgccttgctaaatcatacttaaacaatatcaaaaggaagtaagatgcaactatgcattaattaacacgaagtcaatagaaagttatgcgtagaaaaaacaccgcgaccgctcgcggtgttgactgtttaactaaagggtgaagagtgacgcataatttggtacgttcgatggtttggcttatggtaggtcttactgatattagcactaattggcttagggacatcggttagatcaatccaacgcgatgctttcacgtaagacccgcgatgctgcaagacgataatattgtctttgtgtggtgagtcaatcaagcccattgttacgcttacaatttctgtattttcaccaaacggatcactaattgcttcggtcgcaaattgtttacctggtgttgaccagtgttttggacctgttgcatatgaagttttcatgggtaagaatggatcgaatcgatcaattagaccgatttggaaatatcgacccattgatagcgtaatcaaaaatgcggtaacgacactaattatcaaccaaaatccaaatcggtaccattttgaatgcttaatatttgtgtcgattttggttgcagtttggtatgcatcggatttaaagagttcgctgatttcaacagcgtatgcatctgctatttcaattaaagtcatcaaactgggtgtatctttcttattctcccaacgcgaaattgcctggcgcgttacgtgtaatttttcggcggcttgttcttgtgagaggtgattcgccaaacgtaactctttcaactttgtccctagttccataatgtcctcctgacatatcacttactgataaatagtctgccggaatgacgcatatagtacaagagagtaataagttacatcgttgaccagccttgatttggcgcgcttttcggattacgataaacccagtgaggaaatgatatgaaatttgtaattgcaccagattcattcaaagagagcatgacggcgaaagcggcggctgtagcaattcaggccggcttacaaaagatttatcccgatgcagactatgagttagtgccaatggctgatggcggtgaaggaactgtccaatcccttgttgatgcaacggagggcgaaatcatcactgccgatgtccaaaatccattggacgaaactgtttcggcattttatggtgtgttgggtgaccaacaaacggccgtaatcgaaatgtcagccgcatcaggtattcaattcgtgacgacagagacgaagaacccattgattacgacaacttacggtacagggcaattgattaaagatgctttggaccgtggcatgcgtcgtttcattattggactgggtggctctgctactgacgacggtggcgccggtatggctgaagctttgggtgttcgattccttgatgaaaatggccaacaaattgctcgcggtggtgcggcactagcaacgttgcatgagatcgatatgagcaatcttgatcctcgtgttgccgaatctgaatttttgttggcgtcagatgttaccaatccgttggttggtgaaacgggggcgtcagcggtattcggaccgcaaaagggtgccacaccagcgatggttgccgagttggatgcggcgttgactaattatgccgcagttattaaggcccaacttggcgttgatttggctaacacaccaggtgctggagccgctggcggtttaggcgccggtatgttggcattcacgcaggctaagatgcaatcaggtattagcttggttgttgaagcgactgagctggttgctaaagctgcgaacgcggacgttgcgtttgtcggcgaaggcgcgattgatttccaaacgcaatatggtaagaccccaatgggtgcagcccaagcggttaagcaagcctcaccaaatgcaaaggtgattgggcttgctggttatgttggggatggcattgatgcgttgtatgatttgggtatcgacgcggtgttcagcattgtgccgggtgcagttgatttgccaactgcaatgaagactggtgaggccaatctaacacgaacggctgagaacatcgcgcgattgttaaataccaaataacttttacaaaaacatttcaagcaaacaaaaacggctattagaagttcttaatatgttacaataatgaacaaggacatatcatttaaggtttgagagccaacagaaacgttgtggatgatgcaaacaacgctcaaccttttctggtgctaccttctagctgcttgtgaaaacaagccgtgcgcccgcgttaacggcatcctaagaggtaatgatgcagaccatcattgcaagcagagtggtaccgcgtgttagcgtctctgttatgcaatggcggtctgtttttatttagatatttatttaagtgaggattggaaagatgaagccattatcatcagctgagattcgcgatatgtttctacgtttctttgagagtaagggacacagcattgagccatctcaatcattgattccaaaggatgatccaacattgttgtggatcaactcaggtgtcgcaactttgaagaagtactttgacggtacggttgtacctgaaaaccgtcgtattacgaatgcacaaaagtcaattcgtacgaacgacattgaaaacgttggtcacactgctcgtcaccacacgttgttcgaaatgatgggaaacttctcaatcggtgactacttcaagcctgaagttattccttgggcctgggagttgttgacgagcccagagtggtacggcatggaacctgaaaagttgtatgtcacggtttaccctaacgatgaagaggcaaaggatatttggttgaacgtggttggtttgccaaaggatcacttgtacgaagagccagataacttctgggatatcggtgaaggaccatcaggacctgacactgaaatcttctacgaccgtggtgaagaatttaactcagacgatccaaaggaaaactaccctggtggtgaaaacgagcgttacttggaaatctggaacatcgtgttctcacaattcaatcacttgcctggtttgactgacaacaaggactatcctgagttgccacacaagaacattgatacgggtatgggactagaacgtgttgtctcagtgtttcaaaacgctaagacgaactttgaaacggacttgttcttgccaatcatccgtaagacggaagagatgtcaggtcaattcaagtacggtgaggatcctgaaaaggacatctcattcaaggttatcgctgaccacgcacgtgccgtaacgttcgctatcggtgatggtgctttgccatcaaacgaaggtcgcggttacatcatccgccgtttgctacgtcgtgctgttttgcacggtcgcaagcttggtatcagcaaggtcttcttgaaggacttggtaccagtcgttggtgaaatcatgaagtcatactacccagaagttttggagaacgcagactacatcgcttcagttgttgaagctgaagaagttcgtttcaacaagacgttggctgatggtttgtcattgttggatggtgtcatcgaagaagctaaggctaacggtggtgttattgacggtgccgttgccttcaagatgtacgacacgtacggattcccatacgaattgacggaagaatcagcagctgatgctggtttgacggttgatcgtgaaggcttcgatgctgagatgaaggcgcaacaagaacgtgcccgtgctgctcgtggtaacacagcatcaatgggtgttcaaaacgctttgttgacagatttgaagacggaatcaaagtatgttggttggtcagaattgacggttgatgccgctaagttgacggacttgattgttgataacgaattggttgactctgctaaggacggccaagctgaagttatattcgacgtaacgccattctatgctgaaatgggtggtcaagttgctgaccgcggtgttgtcatcaacgctgctggtgaagtggttgccgaagtggttgacgtgcaaaacgcaccaaacggacaacacttgcacacattgaatgttaacgctgaaatcaaggctggcgagacttacaagcttgaagtgaaccgtgcttaccacgctgctgtgtcaaagaaccacacggctacgcacatgcttgaccaagctttacgtaacatcttgggtgagcacacgacgcaagctggttcattggttactgaagacggattgcgttatgatttcacttacaacggcgctgtttcagctgaaaagttgcaagaaatcgaagacttgatcaacgaaaagattattgaaaacttgccaatttcatgggttgagacggatatcgaatcagctaagaagttgggggctgttgccgtctttactgaaaagtatggcgagacagttcgtgtcgtttcaatcggtgacttcaacgtcgaattcgacggtggaactcacgcaaactcaacggctgagttgggaatgtttaagattgtgagcgagcaaggtactggtgccggtgttcgtcgtatcgaagccgttactggtaagggtgcaatggacttgttcaagcaacacgatgcttggttgaacgaagctatggcacaagttaaggcaccacaattgtcagaagtaaatgacaagattgctgccttgcaagcgcaattgaaggatgccgagcgtcaagttgcatcattggagcaaaagttggctaaccaagctgctgatgctgcctttaacgatgttcaaacggccggtaacttcacgttgattgcaacggaaatggccgttgaatcaatggatgccttgcgtgcaacggcagataactggaagcaatcaacaccatcagatgttcttgttttggctgctaacttgggtgaaaaggttaacctattggttgctgcttcacctgacgctatcgcaaagggtgttaaggccggtgatttgatcaaggccattgcacctgctgttggtggtggcggtggtggtcgcccagacatggcacaagctggtggtaagaaccctgctggtattaaggatgcctttgcccaagcaactgaatggttggctgcaaagtagcatttgattagaggataattcctcagaaggaggctgcatatgagttcattggataatacagctgtgtttgattttggtaacaaccaagatcacgacgtgcgtaagacgcttgaaattgtatacgccgcattggaagaaaagggttacaacccaatcaaccaaatcgttggttacttgatttcaaacgatccagcgtacattccacgtgtaaatgatgcacgtaacttgattcgcaagttcgaacgtgatgaaatcattgaagcacttgtgaaggattacttggctaagtgatctgattcagaaaggaatggtcgattaataatgggacgaattatgggacttgatgtcgggtcacgcacagttggtgtggcagtttctgacctacttggttggacggcacaaggtgttgaaatcattcgcattaacgaggatgaaaaagagttcggtatcgaccgtatgaaggaactagtagcccaatttgagccaactggctttgtacttggtctaccaaagaacatgaataatacatctggtccgcgtgttgaagcagcgcaagcctatggtgaattgctaacggaaactttcgggttgccaatcgatttccaggacgaacgcttgacgacggttgaggcagaacgtatgcttgttgaggaagctgatgcgtctcgtaagaagcgcaagcaggtgattgataagttggcagctgccttgattctccaaaactatttggatcgcaaaggcccacttgtaaagtaagaggtaaattgagatggacgaagagcaagacattatcacgttgatcgatgacaatggcgatgagcaacttttcgaagtattgttcacgtttaagtcagaagattacggtaagtcatacatcgttttgtacccagctggtgcaggcgaagacgaagaagtagagatgttggcatacatctttgacccagacgagactgcagagtctactgagggtggtttgacgccaatcgaagacgacgatgagtggtcaatggttgaagagcgtttgaaccaattcttggacgaacaagaagactaattttagtacaattgatggccggtgatgaatcggccattttttgttaagtgcgaaaggaatccgacatgaacgaagctgaattgtttatcttgactgacgaagaaggtaatgagcacgaatttattgagttgttctcttttgattcagaagactttggtaagtcatacatcatccttggccctgctgatgcagctatggacggtgatgacgaagaagaagttggtatcatgcccttcatctacaacaaggatgacgaagaaggtatgttgcaaccaatcgaaacagaagaagaatttgatatggttgaagaggtgatgaacaccatcttcaacgatccaaacttgcaataaaaatgatttgcgacgaattttgcgattcgtcgcattttttttggactttttgccggttttcacctctttattgttggagggaaaataaatgacgacttttaaagcactttattatcggttccaacatgtgattttctttttcggcggtctggttgcggtgggtatcggcttaattgtttggtggcagtgttcacagacaaaaccggtcttgcctcgtgacgtgtcaccgagcatcgcagcggatcagtcttcacaaacgccaagtagtgttagcaaatcagtgagttcaactactgccaaagtggtgattgatgtcaaaggtgcagtgtatcgaccgggcgtttataaattcaataatggaccgattatggctgatgttcttgaaaaagcgggtgggacattgccgacggttgaccgaacacggcttaatttagcagcaccattggtgaatgggcaggtgttatatgtaccaaatggaacggaagacgttcctgaacagtacccgttacctggccaagcgacgacaatgagtgcgacgggtggggatacaagtagcgagactatcaatctaaatacggcgacattggcagagctgcaaaaactgcctggtgtcggtactaagcgtgcacaagatattattgaccaacgtgaaacgatgggtgggtttaaaacggtcgctgatctacaagaggtgtcaggtatcggcgagaaaacgtttgcgaaattagaaccgttggtcacggtgtaatgaacggctattggttagtgactggattgctagttggcacactaaatgtcatgatttgttatcaattttggtgggccgtaccaatgtttgcatggttgctgattttgttggtgactcgttttaaaaagcgactgtgtttgactgttttgattatagggagttacgggacgttttttggtgcgcatcaggttcacctgaatcaacttggcgaccggccgataggtgatgttaaaacaaccgttatggtgcatccggacgaattgcatttcacaggcacaacaattactggcttcgccacgttgccaaataaagaacgtgtccgtttgacttggttctgtaaggacaaaaaaccgtttcgcgagttacaacgacgtcatgatgcggtggtgatatcgggtagcggacaatacgaaaagattgcaccacggcggaatgcatacacctttgatccagtggggtattggcggagtcgtggtattatgcaccaacttgttttgacacaaggtgaggtgaaaagcgcgtatgtaccaactaatgcgggtgagtttgttgttttgcaaatccgaacctggcatcgcctgctagtacaatggtttgaacggttaccgcctggtctacgtgattacggcgagacgttgtttcttggctatacgcggcgagatttttatgacgacaatctgggtattcagaaaatgggattggttcatttgtttagtatttccggttttcaagtggctggtttgtatgtgatttggcgtcgaattggccggtggttaggtattacgcgtgaacggtcgttgttgattgtgcagttgttgttacttgggctgctgctatttgcgggtggcgtacaatcgttagtcagagctgttttgttggccctgacccaagcgtggcgcgagttgggatggctaaggttgtcagccgtcgatgcctggggaattgcgctactgggtggccttctcttagaaccaggtgttttgcataacctaggtggccaattgtcctacttgttgacgtttggtttgttatggcttgaaggtaaaccgggatggtggcagtgtgtcttcttgtcgttgctgattttgccgttgttgctgtggcatacatatgcgtggcacccaattggtatcttagcgaacttgattgccatgccactgtttacgtggcttgtaattccagttctaaccgtaggcatacttgcagcgtggttgaacattacggctttaactaattggtgtaatgcagttgttgatggggtgcgttggacgattgcacaaacggaaggcttgccaggtgaattaacatttggacagccaccggtgttgttatgcgcgattgttttaatcggcacgctagtttggctggccgttcgacggtggtggatattgggcattttaggcactgtttacggcatcatgctgttgttgcctaatttgctaccgggtggttttgcgacattcgtggatgtcggtcagggcgatgcaaccatcattaaacaacgcgctaatcaagtgatgatggttgatgtcgggggtaagctacagttgccacaaccagattgggcagcaccccgcaagacggattttcaagcgcaacagttagcgcagtatctaaaaggtaacggcatcactaaaattcagcagttagtgctgactcacaaggatgtcgatcatattggtaacttgccgcattttctaaaactggtgcgagtagagacgatttatgtgccgttggggatgcaacagagtgacgcatacaaacgattggttgcgccttatatcggaacgactgaagtccgagaagttcgcgctggcatgcgcttaaatgaatggacaacggtacagcatccattcgaagcgggaactggcgaaaatgaggattcggttgcattgctcgtgaacgtcggtccaaaacagctaatgatgacaggcgatttagaccaggctggcgaggaacgaattatccagaacaaccaatttcgacaagtggaacttctgaagctaggacaccacggttcaaaaacgagtaccgcacagtcatttgtgcacgcgttaaagccacaaattggtattgtttctgctggtgtgaataatcgatttggtcatccgaacaaagaaacgctgtcaacgacaaaggaggcggggatgacagtgtttaatacagcagaaaacggcatgttgcagtaccattggtgtggtaatcgagattggtggcaagctgaaatcaagtagctattcacgttcaggagtcaacatgatacagtagagatacgattaaaacgaggaggcgtgggcatggcttatacgctgaaagatgtgcaacaagatgttgcaaagcaaacattgcagccaatttacctaattcaaggtacagaccaatatttgcttgatcaagttcgtgcggcgtttgtgagtctgattccaggtgaagatcgcacgttgaacttggcacaatttgatatgcgtgaaacggcgttgggtattgcagtggatgatgcgcggtcagtaccgttttttggtgaccgacgtgtcgtgattattgacgatgcctacttcctgaccggtgaaaatccacgaactaagctggaacatcacgtcgaagatttattggcctacattgaacacccagagccacagacggtcttggtgatttttgcaccatacgagaagctggatagtcgcaagaaggttgttaagttgctgaaagagaaggcagcttacttggcctttggtgatttgactgaaaaagatgtgcgaaacatgattaatgataagttgcgccaaggcggttttgaaatgtcaggacctgccatgcaactactaattcgtttaacgaatatgtcgttaacgcaaattatgtctgaactcgataagttgatgctttatgcgtacgatacgaagcagattgacgagcaggctgttgatgccttggtaactcgtacgttgagcgaaaatatcttcgacttaattaatgcgttgttgaaccgcaagttaacacgcgctgtggagttgtatcacgaattggtcgagagtggtgaggcaccattgcgattgcacgcagcgttgttaggacaattccgcttgttgttacaggtgaagtcatcaactcaaagtgagtctggtacggcatcaatgttgaaagtgaatccataccgtgtgaagcttggccgtcaaacggtacgtcgcttcagttataccgcactagctaaggcttatctggggctagttgatatggaagaacagctgaaatcaacggcacgtgaccctgaattactctttgaattattcgtgttgcgttaccaagctgatattgcataggatttctacttgcatcaagttagaaagtttagtattatatttgaagtgcaaaagcacacgaccttttacgatgtttgacggttcaccgtcgtcctacgttgttttaggcgactatatattaagaaaggtggatatccaacatggctatttctgcacaacgcaagaatgaaatcatcaaggaattcgcacgtcacgaaggtgatactggttcagttgaagttcaagttgcagttttgactgccgacatcaacgaattgaacgcacacatgtcagagcacaagcacgacttccactcacaacgtgggttgatgaagaagatcggtcaccgtcgtaacttgttgcgttacttgcgtgacaacgacgttcaacgttaccgtgagttgatccaaaagcttggattgcgtcgttaatttttacattaacaacgtacgttattttgacatttatcatcggagggaaaagcgatgccaattattgagtcatcaatccaacgtgcccgcttgaacaaggtgcaacgcgagcgtaacatctcacaattgagtgcataccgtactgaagtgaagaagttccgtaaggctgctgaagctggtgcagacaacttgcaagagttgtttgttaacgctacgtcagctatcgatcgtgccgcatcaaagggcttgattgctaagaacaaggcttcacgtgacaagtcacgtttggcagctttgttgaacaagtaatttattacttgcgatagcaaactgaaaaaagaccaacatcttcgggtgttggtcttttttgttgtgttcataaaataacaaaaactgaatgctaaactgaatcacctataaggggatcagaaaatgaaattcaaatttgccttaggcattgttataacgatgatattttcagtgataattaccattgacgtactttatatgccactaaagctagcactcgaaagctctgggaattttttggaaccgtcaacaccaccgacgcaatctgaaaacttcaattttttcgcgaaactattgttaattgagattgtgccaccaatcatactgacggtgatcaatatcatcatcacaaaatcaatcggcaaagagagcatcgaaatgcaaactaggtttgtgattagcagttttgttgttttctgggcgacgccgattttgattgtggttctagggcgaaaggtgtcggaaatattgcaggtataattttttcgttgttggtagggtaggcattgtgtggtaaactgttaataaatcatacaaacgtttgggttgtgctgacccgtgaaatataacgagaataggaacattatggctacgacattaagtattatgccgttcggtggtgtacgtgaaaatggaaagaacatgtacgcagttaccgtcggtgaagacatttttattttggatgcagggttgaagtacccagaaagcgatttgctaggagttgacgttgtcattcctgactttgcctacttggtagagaacgcagataagattgccggtgtctttttgacacacggacacgcggatgcaattggggcattgccttacttgttgagtgaggttaaagtgccggtcttcggatcagaactaacgattgaattggctaagttggctgtggaagcagagcctgaagcaaaggggtttgatgattaccacgtggttcgtggtaactcagaagtatcatttggggatgtgaccgtttcattctttgagacgacacacacgattccagaatctcttggaattgtaattgaaacgccagaaggacaagttgtctacactggtgattttaagattgatacaacggcattgccatactaccgtactgatttggcacgtttggcacaaattggtgccaagggggtaatcgctttgcttgctgatgcagcaggtacagctagctatggtttggcagcccacgaatctgaattgggtagctacgttttggatacgttccgcggtcacactgagggtcgtattatcgttgctgcagtcgcttcaaacatccaacgtatccaacaagttatcgacgcagccttcaaggttggtcgtaagattgtgatttctggaaacgacttggaaaaggttgtacgtactgcgttgcgtttgaagaagttgcacttgccaatgcctgaaaacgaactatttgtttctttgaagaacttgagcaagttggagccaaacgagacggttatccttgaaacgggtaagatgggtgagccaattcgtcacttgcaacgcatggcgcaaggtgatgatcgcaacatccaaatccaagaaggtgacttggtattcattacgacgacgccttcaacggccatggaaggttacgtggcacgtacgcgtgacatgttgttccgtgccggtgcaacggttaagcaaatttcaacggataagaagtcttcaggtcacgcatctaaggaagatttccaacttttgttgaacttgttgaagcctaagaatgttatccctgtgcaaggtgagtaccgtgtcttgaatgcagcttacaaggctgctgaacaagttggttacgatgataaccacgtcttcttgcttgctaagggtgacaaccttcgctgggatggtgaagaaatgtacttgggtggctcaatccaagttggctcaacaatgattgatggatctggtgtcggtgatatcggttctatcgttttgaacgaccgtcgcatcttgtcagaagacggtgtcttcatcgccgttgtgacgattgatcgtaagaagaagaagattatctcaaagccaaagattgattcacgtggattcgtttatgtgaagacgtcacgcgatttgattcgcgaggctggtgacctggttgagacgaccgtcgctgaaggtatcaagaacgctaaggaattcgactggggtaaccttaagaactctgttcgcgatgcattgggtaagttcttgtacgagcaaacgcgtcgtaagccagtgattttgccagttatcatggaagctaaccaaaatggtcgtcgtcgcaagcgctcagcaagcaagacgaacgctaagaaggctgaagctcctgaagccaacaagtcacaaaagcaaaacaacaagccaaagaagaagcagaacgcaaacgctaacaagccagcgcctgctaagaataataataatcaacctgctaagccagctgaaaatggagcggaggtcgctaagaaaaagaagcgccgtccacgccgtcgtaagccaaaggcaacgcaaggtgaatcagcaccatcagctgaataaaacacaagcgtcgattctaacgggtcgacgcttgtttgttaggaaggatgcatcatgaacgaagaacaaacgcagcgctatgagctactattagcaaagggaaaagaagcctatgagaatcatgcattcgggccagcactagatgcatttgatgaagcgtatgatttgcaacaaacgccagaacttaatcaattgattacccgtgtgttattagccgatggtcagttcaagacggcacaattgtttgcggatgaattcattgattcatatctagaaagtgccgaattggctgaactatatgtcacggtggcattaaagaatcaacaatttatcgcagcgcgagaatttgtaacctgggttgcaccagatgttgctacaccattaacaacagagattgagacggccgaagaaacctttagaacagaacaaaaggcgacattaaatacaattgcgcgccaattctatcatttgagtgatggggatgctatcaatcaaaaggaacgcctgattgcggctgacaagctgccattacgcgaatacctggttggcgcacgctttgcattagttgatccattcctgccagccattgcgcgggtaacggttttggataagttacgtcgtttgcaggtaactgagtcggtagacatgacctggttagacgaaaaggtaatgacaatcgtgccaaaggacctgcaatcgctagatgaaatgccacttttccaaacggtagtggcgacattatcgggttatgaacatgaatttggcccagctacggtacatgccttagttgaacaagcacgtttaatgttgatgattgcttatccagcgattgatcgggttgttgagaatccacgtgcttgggcagcaggcttaatggccgaagcaatgggggaaaatgccccaacggagccggttgagcaacaatcttggcgggcaaaattagggcaagaaatgatgggattaatgccctaaaaaaactaatttgaaattgatagtcgaatttaggtaaaaaatatttacaaaaatcgccaagttatatataataattccagtctcatatagagaaattacaaagattttcgcaccaagttgttttagttctgtaaggaatgtagtataatactatttaagcaataagggttagcccatttaagggctaacatgcgaatattaggaggacaagcttttggctaaggaaaatttcgagcgcactaagcctcacgttaacattggaactatcggtcacgtcgaccacggtaagactactttgactgccgctatctcaaaggtattggctgacaagggattggctgagcaacaagactttgctgctatcgacgctgctcctgaagagcgtgagcgtggtatcacgatcaacactgctcacatcgagtacgagacggaagctcgtcactacgcccacatcgacgcccctggtcacgcggactacgttaagaacatgatcactggtgctgcccaaatggacggtgctatcttggttgttgcttcaactgacggtcctatgccacaaactcgtgagcacatcttgttggctcgccaagttggtgttgactacttggttgtgttcttgaacaaggttgacttggttgacgacgaagagttggttgacttggttgaaatggaagttcgtgaattgttgtcagagtacgatttccctggggatgatattccagttatccgcggatcagctttgaaggctttggaaggtgacccagaacaagttaaggttatcgaagagttgatggacactgttgactcatacatcccaacgccagagcgtgacactgacaagccattcttgatgcctgtcgaagacgtatttacgatcactggtcgtggtactgttgcttcaggtcgtatcgaccgtggaactgttaacttgaacgatgaagttgaaatcgttggtttgcacgaagacgttcgtaagactgttgttactggaatcgaaatgttccgtaagtcaatgcaacaaggtcaagctggtgataacatcggtgcattgttgcgtggtgttgatcgtaaggaaatcgagcgtggtcaagttttggctaagcctggttcaatccaaacgcacactaagttcttggccgaagtttatgttttgactaaggaagaaggaggccgtcacacgccattcttcactaactaccgtccacaattctacttccacacgactgacgttacgggtgtagttcaattgccagaaggcgttgaaatggttatgcctggtgacaacgtaacattcgatatcgaattgatcgcaccagttgccatcgaaaagggattgaagtttacggttcgtgaaggtggacgtactgtcggtgccggaactgtttcagaaatcaaggactaattttacggttaacgtaaaattttccaatgtagcttaggctgctcaaaaaagagagttatgacatattcgtatgtcataactctctttttgtttatcacagcagctgttggtcttacgcctgacttcagtcaggcgtaagaccaaagacgcacttgataagggcgacttggtcacgtcggaggccaaaaaacctccgacattctcagtctgctttatccaggcagattgctgggactttcgtctcgtgaatggtattctgacggtaattactaggtactgggggaatatcaccatggcgagaccgaagacaaaagcagagctattaactgcgtcggaacagcaatttgagaatatgtggcagttaattgatgccatgccggatgaagaacaagcagccacctttgcatttggtgcagagatgggtaaggaagcgcattggggacgcgataagaatatccgagatgtgttgattcatctttatgaatggcaccagctactactgcggtgggtgaatgccaatctaaatggcgatcagcaaccgtttttgccggcaccttataattggaaaacgtacggtgagatgaatgttggtttctgggaaaagcatcaagagaccacattagcagatgcgaaggtcatgttacatgacagtcatgacaaagtaatgacacttatagcagagttttctgatgaagcattgtttaccaaacaatatttctcatggactgggaccacgacgctagctagttattgtatttcagccacagtcgcacactatgagtgggcaataaagaagcttaaagcacatcagaaaacttaccaggcgtaatgactggtatgacaaggctcttggtattcacatgaattcaagagccgtttttctgcaaattttgttgctcacgaccaacgcaaatgtgatagagtagcttatacacttttttcaatgaagaggagctttaaacaatgcaaatttatttggcagcaccattctttagtgatgagcaaattgatcgtgtcgcgcgtatcgaagcagccctagaggctaacccaacggtgactgatttctactcaccacgccaccaccaaaagacagataacccagaatactcgccagcatgggctgcagaagtattccgtcgggatgtcacacaagtgttggacgctgacgcattggttgttgttgctgatttccgtgatgatgatgctgattcaggtacagcctttgaagcaggtatggcatgggcattgaagaagccagtaatcatggtcgaagagacggactacaagactaacttgatgttgacggagtcattgacggccttcgttaacaaggctgaagatttggcaacttatgactttaagaactacccagagtcaaagtttgaaggtcaacttttctaagttcgtttttgtcggaaaaatgtcgtgttttggcctacatttattgccaaataacggtttttccggtaaacttataaagtatgtaaagataatatatgtcgtcggtctttaaccggtgactattggaggaataaacatggcaaacgcagttttcactaagggtgaaggcaacaagggaacgatcaagttcgaagttcctgttgacgtatacgaaaagggtatcgacgccgcatttaacgacgttaagaagcaaattacggttcctggtttccgtaagggtaagatgcctaagcaagtctttttccaaatgtacggtgaagagtcattgtaccaagacgctttgaacgttgtattgccagatgtatttgctgatgcagttgctgaagcaggtgttacgactgttggtcaaccaaagatcgacgcagagtcaatgaacaagggtgaagcttgggttttgactgctgaagttgaattggcaccagaaatcgaattgggcgagtacaagggtgttaaggttcctgcatcagacgttactgtttctgatgaagaattggacgctgaaatcactcgtttgcaagaaggtcaagcagaattggttttggttgacgctcctgcaaagaacggtgacacggttgttatcgacttcgttggttcagttgacggtgttgagttcgacggtggaaagggtgagaactactcacttgaattgggttcaggctcattcatccctggcttcgaagaccaattggttggtgccaaggccgaagacgttgttaacgttaacgtaacgttcccagaagaataccaagctgctgacttggcaggtaaggacgctttgttcgttgttactgtgcacgaagttaaggctaaggaagttccagctttggacgacgagttcgcaaaggacatcgacgaagaagttgaaactttggcagaattgaaggacaaggttaaggctcgcttgacgacttctaaggaagatgcagctaaggatgccaaggaagacgcagctatcgcagctgttgttgacaatgcatctgttgaaggtggtcaaattcctgactcaatgattcacgaagacgttcaccgtcaaatgaaccaattctttgcttcaatgcaacaacaaggtatttcaccagagttgtactaccaaatcactggttcatcagaagatgatttgcacaagcaatacgaagaaggtgctgagcgtcgtgtaaagacgaacttggtattggaagctattgttaaggcagaaaacatcaagccatcagctgacgacattgctgctgaagtaaagtcattggctgaccaatacggtatggacgaagctgctgttcgcggtgctttgtcagacgacatgttgtcacacgacattgctatcaagcaagttgttgacatgatcgttgataacgctgttgaagcttaattcaattaaacgttaaacaaaagaggttagactttttcgagtctaacctctttttgcagtgttacactatataagtcctaagaatatcgtataaaaaaacacaaaatctctggtacaatagtaggtaacttacgtttagtctaacgtttaaaaacttacaggaggttgaacagtgtttaatacaaccgataattcaaacggcattgcctactgttcattctgtggtaaggcttctactgaagtgaagaagcttatcgcagggcctggcgtatacatttgtaacgaatgtgtggctttggcacaagatatcattaatgaagatttgcaacaagatgcattggagcgcacattgactttgaaaacaccacgtgaaattgtcgataacttgaattcttatgttatcggacaagacgaagctaagcgtactcttgcagttgccgtctacaaccactacaagcgcgttaacgcgatgttgacgggcgaaactggggctgaaggtgttgaactgcaaaagtcaaacatcgccatgatcggacctactgggtctggtaagacgtacatcgcacaatcaatggctaagctattgaacgtgccattcgcaattgcggatgccacgactttgactgaagctggatacgttggagaagacgttgaaaacattctattgaagttgatccaagccgccgactacgatgtcgagcgtgctgaaactggtatcatctacatcgacgaaattgacaagattgccaagaaggccgaaaatgtttcaattacccgagacgtttctggtgaaggtgtgcaacaagcccttttgaagatgctagaaggtacgattgctaacgttccacctcaaggaggacgtaagcaccctaaccaagagttcattcaaatcgatacgacgaacattttgttcatcgtcggtggtgcctttgcgggtattgaacaaatggttaaggagcgtgttggtgcgaaggttattggattcggaacggattcaaagacgcaacaattcaacacgtcagataagtcaatcatgcaacaagttgtgcctgaagacctgatgagctttggtttgattccagaattcattggtcgtttgccaattttgacagctttggaagaattgactgaagatgacttggttcgcattttgacagagcctaagaacgctttggttaagcaataccaagctttgttggccctagaaggtgttgctttgacgttcacgcctgaagccttgaaggcaatggctcacttggcaatcgagcgtgagacgggagcccgtggtttgcgttcaatcatcgaagaaacgatgcgtgacgtgatgttcgacgtaccttcacgtgatgacgtcaacggcgttattattacggaaggtgccgtgttgaaccacgagcaacctgaattggtcactgaacaagcataatttaacggaggatttatcatggaagtacacaatgtcgaaatggtaatgtctgccgttcgtgcgagccaatacccaactgatgggttgccagaggtggcttttgttggtcgttcaaacgttggtaagtcatcattgacgaacgttttgattaaccgcaagtcatttgctcgtacgtcatcacaaccaggtaagacgcaaacattgaatttctacaaggtagaggatcaaattttcttcgtcgacgtgcctggttacggttatgccaaggtgtcaaagaaggcccgtgaagaatttgctgtgatgatcggtgaatacttgcgtacacgtgagcctttgaagggaatcgtgcaactagttgatgcccgtcacatgccttctaaggaagacatcgagatgtacaactggttgacgtcagatgacattggcttgccagtgcttgttgttgcaacgaaggccgacaagatttcacgtggtaagtggaacaaggctgaagctgacatcaagcgtgggttgcaattcaaccccgatgtttctgattttgagattttctcatcagaaacgaagtatggtaaggacaatgtttgggattggctagaagctcgtatgctagatggtacggacttcaatcctgaagattacgaagcctaaaaaattatacccatgtcatttattggcatgggtattttttgtatgtaaaaacagtagattgcaaccgttttcagatgcaaatttgatgaaataagagctattctttgaattcaccctcactcggcggtactatttagtcatcgtttaggagggcattcgagtatgaataaagtagttaagggagtagcgcttgcatcagcaagtctaattttgggatcaatcgtggtaccaacggcaacgcaagccgccacatataagacaatcaattggacggagactgcgcaacttggcacaatggaccaagcaaagtcgtctgctgccgttgattttgatgccatgcaagccattggggatggtttgtaccgcaatgataagaacagcacaccacaattggcattggctgaatcagctgaaaagtcagatgatggtttgacatatactttcaagcttcgtccaaatttgaagtggtcgaacggggatgcattgacggccaacgactttgtttatggttggcaacgtactaataatccaaagacggcgtcaacgtatgcatacctattttcaggtattaagggtgcggatgacattcagtcaggtaaggacaagaacttggatgatttgggtgtaaaggcgctcgacgacacgactttggaagtcacgctcgataagccaatgccacagttggaatccattttgacgatggcaccattcttcccacaaaataaggcgttcgttgaaaaggctggtagcaagtacggtacgacggctaagtatacgttgtcatctggtccgtttgtcatgaagggttggaatggttcgaacaacaagtatacgttggtgaagaacaagcaatactgggatgtgaaggcagttaaaacgcctaagattgtggtgcaagccatcaaggaccaaaacactggttataacttgtacaaggctggtagcgtcgacttcacgaatttgtcgcctgatcaagtcactgcgtcaaagaacttaaaggcctacaaggtgattccatcagccacaacggcttatgtagaattcaatcaaaagaattatccagtctaccagaacctgaaaattcgccaagccatgtcatatgccattgatcgtaagacattggccaataagattttgaccggaacggcaacaccagctacaacgtttacagcggccaagttggccaaggatccgaacacgggtgaagatttcgccaagtcagcagctgtgcctggtgcaattgcttatgacaaggccaaggcaaagcagttgatgaaggaaggacttaaggagactggtaaaaagaagttgtccgtccaattgttggctgatgacacagatgcctcaaagcgtatggctcagttcatccaagcgcaatggcaaaaaatggataacgtgaaggtgaccatcaaggtggtgccattcaagcaacgtttggctttgtccgaagccaagaagttccaagtcgtgattgaccgttggggcgctgactatgctgatccatcatcattcttggatttggccacgacgaattcagacttcaactatggtagctggagtgaccaaacgtatgatgacgccgtgaacgctgccaagacaactgatgtgaacgatcctaacaagcgttacgaagattacaagacggctgagcaacaaatcgaaaaacaagttggtgtcgcaccactttactaccaatcatctgctacgttgatgcgtccatcagttaagaatgtggttttgaacccagttggatcaccatatgactggaagtgggcctacaagaagtaactcgcattaaatggtatactggtaccgagaagagggctcagctaccgtagaaagtaggtaacgataatgcaagcgaagcatggtacacaaattgtggatgtctggcaaatttctgatgatatgtcaccagctgtttgggtgcaagatgcgttcaaacaagggctacttcactgggatgcacgtgaagaaaacaccttgatgcttaatgcaccttggtcagttgccatgggggcgtgcggtgactttctgacgcgtgatggacaggaattgcgcatcgtgaatgaaaatgaattcgaaaaagattatcaggtaatcgataatcaatagcatcgaccggaaagcgctgaaatatcagcgcttttttgctatactggtagttatgaataaacaagaagaggaaagacaacatggcagaaaagacacgttttaaaggcgaaattctaggtaaagaaatcacgattacagctgctgaatcacaagcacacatgaaggctgtttttgaattggctaaccaacaattggaccaaatgaagcaattggcacccaagttgtcagatgaccaactcctaaccttgttggctatcaacgctttgtcagaccaattgaagatgcaagctgagaaggatcacgctgaataatgaacttgctgtcaattattattgcagtattgcttctagcggcggtactacgtggtcgatacttaggcttcgtccgcagtttattgtcattgggcggtcgttttgtggtttacgcagtggctgtcttgatgtcacaccgcttgggaagctggattcacgaaacgtttttgatgacggtacaagcgcgttgggcggccaatggggtaccagaatttgtttctgacaaagccaatgaatttttagcatccggtttagcatttggattaatcatgattattggaacgttcattgtgcgttcaatcgagcgtagtttgcgtttcattaatcatgtgcctttgctcggcacggtgaatcgtctagccggaatgctagtttacggccttttagtctacgttgaaatcttctttgttttacaattaacacagacatgggaaatcccttggtaccacgatgcgatgattcagtcacccatcgcccaatggattttgaatcagacaccttacttctcagatgccatctatcaatggtggattctccagtagggattaataagagatattagaggttaagacacatgaataagaaagtcttagcaacccttgagtatgaagcggtaaaggcccaattgcgaccatacctctcaacggctgctggtgaaaatgagttgcgcaacttgttgccaactgcagatgccaacgaaatgcaaacgtggttggcagaaacgtcagacgcagctaaggtgctacgctggcaaggtggtattaacattccgaagttggcggatgttaagcctcacatgcaacgtttgaagattgatgcgtcattgagtgggaccgaattggcgcaagtcggacgcgtgttgtttacgacgggacaaatgcgtttgttcttcgaaaacttggtggaagaccgcggtgagccattggctgccttgcgtccttactacacgcgtttggttgtcatgcaagatttgacgcgtcgtgtgaataccgcgattgatggggatggtcgtgtgaccgatgaagcctcaccagaattgcaccgtgtgcgccaagccatcacgtcgacggaaaatgccatccgtcaaaagatgcaagattacacacgtggtaagtcagcacaatatttgtctgacccaatcgtgacaatccgtaatgatcgttatgttatcccagttaagacggaataccgtagtcatttcggtggtgttgtgcacgaccaatcacaaactggtcaaacgttgtacatcgagcctggtgatgtggttgatatgaacaaccgcttgcgtgagcactacatcaaggagcgtcacgaagaagagcgcgttttggctgaattgtcagctatgttgcgtcctgaagctgataacattcaaaagaatgctgaagttttgggtcacttggactttgtgaatgctaaggcccgttatgctgcggcaacaaagtcacaagagcctgagtacagcccagaaaaccacgtgcgtttgttacaagcgcgtcacccattgttggacccacaaaaggctgtggccaacgatattatcattggtgaagattacaaggccatcatcgtcacgggtcctaacaccggtggtaagacaattaccttgaagacgttgggcttgttgcaattgatggcgcaatcaggtttgttcatttcagttgctgagtactcaacagttggtttgttcaaggaagtcttcgttgatatcggtgatgagcaatcaatcgagcaatcattgtcaacgttctcatcacacatggtcaacatcgttgaaatcttgaagcaaattgacgctgattcattggtcctattcgatgaattgggtgccggaactgatccacaagaaggagcagctttggccatgtcaattttggatgccgttggtgccaagggttcatacactgttgccacaactcactatcctgagttgaaagtttacggctacaaccgcgttgataccatcaatgcctcaatggaatttgatgttgaaacgttgcgtccaacgtacaagttcttgttgggaattcctggtcgttcaaacgccttggagatttcaaagcgtttgggcttggatcaaagcattattgatgccgctgcctcattgacgacagaagattcacaagaattgaacgacatgattgccgatttggttgaacgtcgtaacgccgttttggctcaacaagtgcaactggctcaacaagtcatcgaaaatcgtcaaatgaagaacgattacgagcaaaagcttgaaaagatggaaactgagaaggcccgtacgcttgaagaagccaagaaggaagcgaaccacatcgttgccgattcacgtaagaaagctgataagattatcgctgatttgcgtaagatgcaacttgatggggtggccgttaaggaaaacaagttgatggatgccaagggtgctttgaacgccatgcttcaagaaccatcagctgaaaacaaccgcgttttgcgcaaggctaagaaggcgaagagccaaaacatcgaagccggcgatacggttttggtacgtgagtacggtcaacaaggtacggttaagcgtaagctcaaggacggcaagtttgaagtccagatgggtatcttgaagatggtgcttgctgaagacgaaatcgagaagcaaaacgttgccgaagtgaagtcagagcaaaaggctgcgccaaagccacgcgttaacactagcaaggcagttaaccgtgcgaacgcgtctgcaacgcttgatttgcgtggacaacgctatgaagctgcgatgagtgagttggatcaatttattgatcgtgcattgctaaacaacttgccttccgttgaaattattcacggtaagggaactggtgcaatccgccaaggtgtgcaagaatacttgcgttcacaccgtgccgtgaagaacttcaacttcacgggtcctgatcaaggagccacgtacgctgaactaggttaataaaatatgacgaaggctagtaacgacttgttactagcctttttgctataatcaatttaatgatgtaggcgtggtattgagggcatttgtatggaatggatatggacaacgcaggaacagcatcgactttctgtgttccgttatatggttagaaataaagtgacacgattgtctgacctgatggcagaatttaaattttcacgttatatggtgatttcggtagttgatcaattgaatgaagacattgcccgattaacgggtcaaacaggtgtgttggtcatcgaaaaggggaatgtaattgtatttgatgcgccgttaaatctgctaccgatagatgagttgaaacaatattatttgtcaaactcaaccagagcacagattattgaacacttaattgccgaagattttgagtcgtgggaagacttggcatttgatttaggaatttcaacgcccactatctataaagaaagaacaattgtgcaagaaaatcttgcagttcagggtatcgaaataaccaaagattatcgattagtagggcaggaggaaaatattcgatttctaacctttgccttattaacggtctataatggccaacgtacggccgatgttgccgatgagattaaaaacgccgctaattactatattagtcatgtcatagcgccaatatttggtgagttaaaagactcccagattagtattatttggcatatggccgcgatttggacgaatcgtttttcacaacggcacttcgtttctagcggttttaccaaccagtatctaaacgccacgactgaaatgtctgaacaagcgcaacgacttctaaaacacttgaaagttttgatggctcggaatggccatatgtctgatgaagaattagataatgaggcgcgttttattatcttaatcttgcatagtttaggactattttcgaccattcaaaccgcgcgagatgtcacacctactgtaaagcaatgttggcagcggtttgatgagagcattcaaacgagctataaatgtctgttccggttgtcgatgacacctgttgactccagaaaattaacgtatagtgtcgggcatacactatttcaatttttaatctatccatttgggattagttcagggattcatgatttacaacattttgaagaattttcagaacgatacccactggcgtttcagctgggcactgaaatattgaatgattttgcgcaaaaacaagaactcgattctagtaaactgaaaacggcactcttaaccgaccttgtctcagctttggcaacaggcgattatatttaccaaagcattccaaaggtcaatattgtgttggactttggtaatcatgtgaatatcgaaaatttgctactggaccagttcggaccggtaaccaaagcaaagattgcgacgtcacataggttggacaatcaaacagatatactgttaacagatgtccctcggaaaccggtgactaatgaactagtgtacgtttggcaaggaattgaatctgatcgttatcttaatcagctgattgcagatattaatcggattagttccaaaaaatttaatgcctggcgacgacaaaattaaatatgagaacaagcttcattattggacgttaatcgtttgatatgaagcttttttcattattaaaagtctgataaataggagtttttctattttttcggtctttttttaaaacgaattttattaaagaccgtgctgaaatatgcgaatatggttatcgtttacttttagtcaacgaaaggagatggcgaatgtcgacaagaaaaaacttaattagtcggagtagattttatatttttggattcgcaacagccttaatcatactcatttggtgggccagtctttattccagcgtggtgcaaatcgcaacggcattattagtcctgttaggcatattttcaagtttgattttgccagggttacttatcacctggttaggattgatttatttggttgttggtgtgttaatgctgatgattggatcatttgtcatgggaataccagaaaaaatactcttgttaatcgcgtttccggcatcgctatttttgacgaacgggcgtcggacaattgtcggtgacttaagttggttaatggctaatgaacaacacgtcgcgtcatttactaagaattatcaccctggtttgaatctccagcgctcatataatgccaacaagatttttgaaaagtcagtcagtcgtttcggtacataccctggtttaaccaaggtttgcgtggatgtgactggtattcaatgggcgcacagcgaacagtaccgtcagtttaatgccaatcaatatgatgccgtgatacacgcagtagcgggtgtattgaagcaaaagcgattgccatctgaatttctttatatattagatgatgatatgtttttgattttgtcatttaggctgccgcgagaaacctttactggtttaactgatgagacgaagatggcattgtcagaaatcatggttggcgattacaaaccccaatttcaatggggacatacgttgattacagaggataatgctgaaaaataccaaacgttaccagatgcattgaagcatattcgtcgtgagatggaaacagatcttgtaacggaatatatgaaaaaggagagcgaccatgattaatatctttttttggattgcgctagtagttagtgttgtatttttggtacttgcggcagctttatttgttgcccaatggaccatttattcccgcgtagaagcaacgatgtgcaagttatggggacaagaaagtgaggcataatgatacaccaatttctattgattacaacgttgttttcgatatggttgtcattatcgatggcaatggttacgctgttcggggccgtccacttttggcttaaaaacagtacaaaagagacggaaattataccgctaaagcgttaccccacgatatctattgttgtcccagctcacaacgaagatgttgttattgctcaaacgatgacggcgctcttgaacctgaattatccaccagaaaaggtggaactactgttgtattcagacaattctacggataaaacggcggctgagatgcgtcgtattaaaaagttgcctgagaatcaaaatcgcaatattgtcattatcgagcgaactggacaaggtggtaaggctggggtgttgaacgattccctacaggtggcaacgggcgaattcattgcagtttatgacgctgatgccatgccagaacggaatgcattgtacttcctggttcgtaaagcattagaagacccggagcgtcatgtggctgtctttggtcgtaacaagacgcgcaatgcggaccaaaatttactgacgcaatttattaaccaagagattgttgtgacgcagcgcattcagcatattgcaatttggcatttatttaagattggccgtattccaggcacgaattttattatccaaaaagattatgtgactgaaattggtggatggcgtgatggtgcgttaacggaagataccgatatttcattcaagattatgcagagtggcaagctaattgctttggcttataattctgaggcatttcagcaagaacctgagcatatccgagattactatcatcagcggttacgttgggctaaaggaaactatcaagtggtgattaataatattaagcatctcttcgatcggagtaactggagcgtaaaaattgaaacgttttactacgctgcgactttcttttggtttaatgccgcaattctgttgtcggatatcttatttgcggtaaatgtggtgttttacattgttggtttgttcaatccaacgattacgataccgttcacgtttggcacaacgaatgtcttactggcacaaattttattgtttaattggctcttgatgattttgttgtatgttttgcagattaacattgcaatgtccacccagttcggtcaggcgacgaccaaacaaatctggttatcattcttgtcgtactttacctatacacaactctttatggcggtttcagtgcacgcagttgcgcaagttatcggcgatagtctctggcatcgaaatggtaatgtctgggttaagacaaagcggtttaatgattagttagtgaggtttaaatggtattacatagaagattatggtgggcagtatttgcggttattttggcgttttcgtctattttggtttatgttcgtgtcaataatgaacgggcggttgtacgtgatacatatgaaacgtggcgtgaaacatttgtcgtgaaaaatcacccgggggcaacctatgtgaatgcgggtacgtctaagcaccgggtagcaatgtctgaagcgcaaggaatggggatgcttattactgcgcgtgccggccgtaatggttgggcaaagcaagcggactttgacagtttgcttgcgtattatcaactacatcgcgatggtaatacgtatttaatgagttggcgtcaacaactcaagcagggtgaatggcgtaatgatcaaaatagcgccactgatggtgacttgtatattgctcagtcgttgataacggcagctaaaacttggcccaaggcagctgatcaatatcgtcggcttgcccgaaaaattgcagctgatattttgcgttatgaatataacgacaccgcaaaaatggtgactgtcggaaattgggcaacttcagatagctgggcttacgatgtgatgcgctcatctgatgtgatgccaactgtttttgatgcgttagctataacgactggtgatgaccgttggcgagagatttcaaatagtatgttagataaattgcagacgttgagtgatcaacatgagacggggctggtaccggatttttttattattgaaaaagatcgaattcgaccagctcaacgtgacgaagtgtcaactaaggctgacggtacgtacgactataacgcagcgcgagttccgatgatgctggccaacgcaaccgatgccagtgcccgcaaaattaatgatcgaatgatacacttctttgcgcatcaaagaacgctggtagctggttatcagttgaatggtcaagcgacaaaaacgtatgaatcatcggctttccaagcaccaattttcaatttggccactaacgccaataacgcagatgctgaagtgctgtatcgcaatacgacaaatgttttaaacaaatctgtggcgcaacaaccttattatgatgcaacgatcacaacactagttgctgtaggaggatttaaaaatgattaaagtaatgactgtttttggcacccggcctgaaggcataaaaatggcgccagttattaaggcacttgaaaatgatgatacagtgacaccagtaacggttgttaccgggcaacatcaagaaatgttgcagcctattttggatattttcgatgttaagccggattatgatttggcaattatggagcctcagcaaagtttggccaaaattacgagcaaagttttgcttgggatggatgacattttaacagctgaaaaaccagacgtcgttttagttcatggtgacaccagtacgacactagcaaccagtatgagtgcatttttccatcacatccctgtgggacacgtagaggctgggttgcgaacgtgggataagtactcaccgtttccggaagaaattaatcgccaaatgacagatcgcattgcagatatgtattttgcaccaacgcgattaagtgccaataatttgattcaagaaggttgctcttatgctagatttacggacagatttttctctgccctgtaaactaatagtagaggagcattttttatatgattcgatattcaccagaatttaagcaatctcttgtcgagatgcacaaccaagggcgttctttgggttttgaaaatttttcggtgtagcggcaccttgcggtgtcgaaaaaacctgtccataatcttgacagcagcgccgataaacgtggttaatcatctttgtcgtaaatctttctctttgtcgttcgcttaaggtgattagctgttgtgtggttattactgaagaagctgggttatcgttgatgcccagcttcttttttgaacaattaggcattgaaacggaaaatagtggtcacagatttcagagacaatgcttcaaaattaatttagtaaagtaatgttgaatagggagacctggaaaatgaaaacacaaattatgaaattcctgataatgatcaccattagtgtcattgcggctttagctacattttctactagtggacatgcgcaaattttgaaaggtcgcgtggtcgcttattcggccggagagccaacactggtattacaagaatgggaggttactgtagatacaacagcgacgtatgtcccttatacattgcctagttttctttcagtggttatcaccgggcattttgggaactatgaattgtatacacatcgtgtatcgcaagaattagggttggaacaccaagattcgtataactttagtgttaaggtcgatcctaatatgcaagacggagatatcgttcgtaaagaatactattactataatttagctagtacgaaacctattttggcgccgtcaacgcctgatacacagccaatcacagtgacacaaactcctgacacacaaccaataccagcaccaaataatccaactaacccaggtaaccctatcacaccgacgttgccaccggtaacgaataagccaactgttccgagcgctcctgatgtacccagctcaccaagtaatccagtggtgccaaactcaccgatgaaacccgatgcacctgcaacagtgacagaagaggagcaagaacccacggaaaatctgccggagtctaataatcaaattgatagcaatggtaatttgagagatactacccaacttggggtagtatcaaataacgttttagtgggaactaataatcaaattcaacaagaaggtgttgaattacccgaaactgcagcagaatcaaagttttcatacggtattttatttgtactgacgactgcgatttcgctaataggtatatgcttgaaggcaagaaattaatttttgtgatttacgaaaaaagtacgagtgcttaatgctcgtacttttttcaataacgttgaaaaagtcgaaatcttggtggtctgccaaatgaaaggctgtcattgtattcaaacgtaaatccgtgctccatatgaagagtagtagtacgataaaacatggcgttgacttttatgagaaaagttctaatattacttattaataataacaactgactagtcgttagaggagagttaacatgacagcgaataatgagcatttttacaaaactttccaaccttcacattatgatttgtacattgatgtgaaccgcggtactaaagtaattagtggacgtacgacgatttctggtgaagcaaaagcaaccgaaatttcagttcaccaaaagtatttgacgattacgtcagtgaccgatgaagcaggggaagacctggcttacacggttgataacgaacacgaggctattcgcgtgacattacgcgaagtgggaccaactgctttgacgattacgtacacggcaccgttgactgatacgatgatgggaatttatccatcatactatgaggtggccggtgagaagaaacagattatcggcacgcaatttgaaacgacttttgcccgccaagccttcccatcaattgatgaacctgaagccaaggcgacgtttgattttgcgctcaagtttgatgagcaaccgggtgaaatcgtgttggcaaatatgccggaactacgtgaagaagatggtgtgcactactttgcgacgactgtccgcatgccaacatacttggtagcctttgcattcggtgatttgcaaagcaagacaacccgtacgaagagcggcgttgaagttggtgtctttgccacgaaggcacacaaggcaaatgaattggactttgcccttgatattgctaagcgttcgattgaattctacgaggacttctaccaaacaccatatccattgccacactcatggcaattggcattgcctgatttttcagccggtgccatggaaaactggggcttggtcacatatcgtgaagcttatctaacgcttgatccagataatacgccattgcgtcagaagcaggtggtggcgactgttattgcgcacgaattggctcaccaatggttcggtgatttggtcacgatgaagtggtgggatgacttgtggctgaacgaaagttttgccaacatgatggagtatgtcgccattgatgcgattgagcctgattggcatatttgggagttgttccagactgatgatgtgtcggcagcgttgaatcgtgatgcgactgacggtgtgcaatcagttcacgtgcaagtggaagatccagcagaaattgatgcgctctttgacggtgcaatcgtctacgcgaagggtgcgcgtatgttggtcatggtccgtgcgttgcttggggatgatgccttgcgtaagggcttgaaggcctactttgatgcgcaccagtatggcaatgcaactggtgctgacttatggcaagcattgggtgatgcatcaggcttggatgtcggtgctatcatgacgtcgtggttggagcaaccgggttatccagtggtcacagcagcggttgtggatggtcaattgaccttgtcacaacaacaattcttcattggtgaaggcgaagaaaagggccgtcaatggcaaattccattgaacagtaactatggagccgtgccagaattgctgactgaacatgaaatcgtagttggtgattatcaacaattgcgtgcggagagtggtcaaccattccaattgaacgttggcaataattcgcacttcattgtgaaatatgatgagacgttgttggctgatttggcacaagatgcgacgaacttgtctgccatttcacagttacaattgttgcaagatcaacgtttgttggctgaaggtcgtttgacatcatatgccaccgttgtgccattgctacaaacgtttgcgaatagtgaacatgtggttgtcacgacagcgctttatgatgtcgcaaataacttgaagaagtttgtgacgcctgattctgaagaagagcatcaactacaaatgttctttgatagcttgagtcgtcaacaagttgcacgtttaggttggcacgcccaagccggtgagagtagtgacgatgcgattacgcgtccgttggtcttgcgtgcagcgttgtatgcccaaaatgcagaagctattgcggctgcccacgacttgtttgtggcccaccaagcagatttggcggctttgccagctgaagttcgtggcttggttttgcgtaatgaggtcgaaaactatggtagcgaggctttgtttgatcaactgctccaagcttacgttgcgtcatcagatgcgacgttcaagcgtgatattcaaggcgcgcttactcaaacaccagattcagatttgattgcaacgttgatcagcaagtttgaggatgctaacaccatcaagccacaagatttacgcgcttggtaccgtggcgttttggcaaacaagcacggtcaacaagtggcctgggattggattcgtgcagactggcaatggttgcaagatacagttggtggcgacatggagttcacgacgtacatcacagttacagcagctattttccaaacggctgagcgcttagcagagttcaaggccttctttgaaccaaagttgccaacgcctggattgacgcgtgaaatcacgatggatatcaaggtcgtagaaacccgcgttgcgttggtcgaagcggaacaagaagcagttaacgcagccgttcgcgcagcaaataacgattaatagacaaaataaagaggtagaaaatccgtggattttctacctctttttgtttacatcaaaatgttctcaacgatcttaacgaacatcgcagacccaacgggcatgcagtcttcatcaacgatgaacttagggtggtggttgacgaattcgtaaccatcttcagccaagccagaacccaaaccgaagtaagcgccaggcttaatttccgtgtaggctgagaagtcttcaccagccatcaattgtggcattgggtacgtgttttcttcaccaagtaactccttggccgtgtccaacaccaaagccatttcttccttggcgttcatcactgaaccgtagcccttttggaagtccaaatcgtattcagcgccgtacatggctgttacgtgttcgataatgtcgcgaatcatacgttccatgtcggcacgcacttgtgggttacgtgaacgaactgacgctttaatgtgcgccgtgtgtggaatgatgttgttaacagtaccggccgtgaattgtcccgatgacaccaaagcagcttcagtaggggcaacacggcgggcaatcatgttattgattgattgaataatctctgtcccaatcgtaattggatcaattgattgttcaggtgccatggcgtgggcaccacggcccttaatcgttaggtcgaacaaatcagatgaagctgtcatggcgccgtaagaaaagccaacagtaccggtcttggtcattaggaaaacgtgcaaaccaaagatttggtcaacgtcatccaatacaccagcttcaaccaaggcgattgcgccaccaggtggcatttcttcggcggcttggaagataaacttcacatcaccgtgaatggcatcacgcatgtctgctagagcgaagaccgtaccaagcaaaatggcagcgtgcacatcatgcccacaagagtgcatcacaccagggttaattgacttataaggtacatcagccaattcgtccattggcaaggcatcgatatcggcacgcaaggcaattgtcttaccagggtgcgcaccgtgcaacgtcgcaaccaaaccagttggggctggacgttcaatcgttaggttcggcacatcacgcaacaagttctcgatataagccgttgtttcaaattcttcgaatgacaattcggcgtgttggtgcaaccaacggcgccaggttacttgatcagcaacccgaatcttttcaagcaatgcttccataattaggcgttctccttagattgttttggaataaagcgtgaccacaagaacatcaaggctcccaagattaggaagtagacgaataccatgaagtaagcgccgttagccatgtcgaccaacaacccaatcaacgttggtgaaacgataccacccaagataccaccagtcgcaacgatggcgtatgatggaccgaacttgtgtggcgcaaaacgcttaactggcaatgacatcaatgtgacgaacgtcatggcactgaagaattcaccagatgccaacgcgattgtgatcatgccactgtcagctgatagtgacgccaagaataggctcacagcagccatgatggccgcaaaaccgataaccgtcttttccttaccgaagaaaaacttgccgacaatgtatgaaccaccgattgatccgaccaagaaggccaagccaccgattgccgtgatgtgaccttgcacaatcgtcgatagcttcactgattgaatcaagtaagaaggcatccagttggtcatgccgtacatcatcgcgttaatcgtaaagtttgataggaatagcaaccaaacaaaacgttcacgaatgacgtcagacatcttggcagcgggtgcctgttctgtgacggctgcgtcagtctcttctgcgaacttcttttcgcttggcaaaacgaaacgcaagacgatgccaacgacaacagaggcaatggcaatcatccagaaggcacgttgccaaccgtaatcttgcaaaaccggtgacacgaccaatggcacgatgattcctgaaatacctgatgcggaaatcaaaataccttgcgccaaagtacgttgatctaacggcaacttggtcgcaacttccttggccgcactaggcgcatacccagagtggtcgatggcaccggccaagaaacgaatgataatgatgaacagcacagccttggcgaatccagccatagcggcgaagatggcgatggcggccattgagaagaccaacaaacgctttgaaccaagtttcgtgttcaacaaaccagcgggcacttgcattgaagcatatccaatgaagaaagctgacataaccattcctttttgcacgttactgaaaccgaaatcttgttgcatgctaaccaagatgattccaatcgcgtttttatcgaagtaaatcataatgaagccgaggaatagggcggctaccaatgtgattgtgcgggcagtaaccttggctttcgccggggttgccgttttagtggacggctttgccacaattgtttcgtcatccataagaaaaattctccttctaagactaaatagttgttatagatgaaattagtctactggttgagtatggtaattttgtgaatttcaactaagaagatttctcatggtatagaccacgtataccagccgtataatatccataatttatgcatgctaattcaaaaatccgaaccatctttttcgattttgtccgtcatgattagattaatgacaaaaatgatatgaggggacgttagtatggttgcaaatattcgcaatatggaaattgataacgatacgcaaaatggcatcacggcgatgcgagtatatggggaatctttgaagggctacatgatgcaagaagcgatggcctcattgcactgccagaatggggatgtcatcttggatgaaattctatggcgtttgtatgccggataccgcgaaacgcctgaagccgtagtggaacgggttagggacaagattgaaagcatgggccaaaaggtcgaggatatgaaaattctggcagcgggtgtggagttgctagataaggatcaattcttccgtaatcgctttgttggcgaagttgctgatacgtttgttgaaaagggttatgacattaagttagcacgcccagaaggttacgtattggtcaacccgcgtcgataattttatgaatcaaaaattatttgattgggcaaccgggtaaagtggctgtagtctataataagaaaggagtttccgcatgaatagttcagttatcgcgacggcattttggtcaaatggaattgagttaacagtactgggatggttagttggttgtttagttttattcggtgttgtatcagcactcggtgaactaagttggcgtaaaactgctaagcgggaacctgctgtcttcgtacgtgccggtatgattttcggtatgacggtcattggattggtgatgttgtcgtcagtgtcagctttcttatttgccttgggacaataaataataaaaagggcggccagcgatggccaccctttttatttttacgactagtggaatatttgtttggtgggtataaggtcggtttagatacactaggacatgtttaataaagcacatgtaaggagaatgatatgggagagtacaaatttgcacatctaacattagaggtggaagacacaatgcgcgtggcaatttctgaagaagaagattttgcgacggtgctccacaaaacagagagtaatgagggggtgacattatcattgttcattgaggatggtgctgttaaatttggggatatacctttttacctttttgcgatttcctttgaagctggtgatcgaatggtgattaagactcggtctgaactgtagaatttgcacacggtataagacaggtttagatacacttgatcatgtttaatgacacacgtgcaaggagaatgatatgaaagaatacaaattttcgcatctaacgttagaagtggaagacacaatgcgcgtggcaatttctgaagaagaagattttgcgacgctgttccacaaaacagagaataatgaagggatgacattctcattgttcgttgaagatggcgctgttaaattgggggagctacatttttacctgtttgaaatttcctttaaagctggtgatcgaatggtaattaagccccggcctgaacagtagaatttgcacacagtattcactgttagttaggggtcgatcagcgatggtcggcttttttagcttgctctggtaaaataagtagattgtggaaagaggtttaggttgatgagtgacattaacgaacaatataatcatgcgcgctctttgattaaggccaagcagtttgctgaagcgcaggaagttttgcagcaggtgatggcaagcaagtcgggttacaagtcggcacgctattatgctgggcgcgctgcgtttgcgttgaaaggttatgaaaaagcgggacaattattcgccggttttgtccgccagaagccaacacctaaagtgaatatagcgaatgcttattcttatttagcacggttggcgattcttgatgaggacagcgatagcgcacgcaaactcttgcagcgcgcggcctcacacggattagtgaatgaccgtttagaaaagattcaagcccaaatctggcagttagaaaacgaatttggtgatgatgagccagttttgaattcacggatgaatgttcgactagaccgcttggcatcgaacggtacaccgattgtcacgacgacggaaaagggctatcaaagtgcctcgattttcgtcgataagctgtcgtatgatcaaatacaaatgctgactgacaaggaatggcatcaactacgtttgacgaccccgcgttggacaaatattcctgggtatatgagtgcgtcggctttggagtcacggacgctgtacgaaaagttcttgccacggatgacggatattcggtatatgtcagcgttcaacgattacttagaagagaatgcgtacttccaacaaaaatgggaactatcgaaggtttttgcgttactgcaagtaccggaattcaataaagcgattgttgcgcaactactagatgaaagtcgtttgactgacggacaggtattaaagcacttggcagccgttgatgacctggtgatgctaaaagcgagtggtgaagtgctaccagtttcagaacggcaacgtttccgttcgctagaattgatgcagtcacctgaattcggttttattaacgaagaagagcaatcgggtttgttgtatttgaaatcaaagctggctgatgaacgtttggtgcgtaaagcattggctagtacaacagatgcgcaattgccgttccgtgataaagtgactgatttcgagccaattggtgagcaaactgactttatcaattggattaagcaggagaaacgacgcctggttgcgctactcggtgttggtggtagtggtaagacatttgtgttgggtaagattttgaataccgatgccgtcgttgccttggcaccaacgcacaaggcgaaattgaacttggtcgataatggttttaaaaccgttgggacggtccaatctgtcgcagcggacacggataccgcccaagcattcaaacaatttgatacggtcattattgatgagatttcgatgatgtcgatggaaatgatggcaaaggtattggccttctttggaccagcaacgcggtttattctgattggggatgacgcgcagttgccaccagtcagtttggatgaggatgccttgtcggtgacaggtgatttgattgggttgattcgccagttcgggactggttttgtctttcaaaataatcaccgtgctaaggtgccagcgttacgcgagttcattgctcatgtgcgtgcccaggatgatcactttattcagaccgcagggcaatatcaaacggctaagtatggcgaaatgctacaagataagcgtcgccacttagaatttgatgacgtgatgattctggcgtacaccaatcagcgtgtcgctcaggtgaatgagtatttcttcaaggcattggccactgacgaagaagtggtggtgccgtttaccaagcgcggtaaatatggtcgtggtggcttctttattggtgcgaaagtcatgttctacaacaacgacgatacgcatcaatatggctatacgacgagtgaatatggcgaaatcaccaacctgcgtgtatcagacatgaatggcgattatggtgaagttgaagttacggtgccagccactgggcaaacgtataagctccccgtctggcaagcaaaacgcgatttgctactagcctatgcgattacgattcacaagtcgcaaggtagtggtgcacgtaaagtttatgtgatggaagcagctgattatggcttagcctacacagcggtttcgcgtgcgaaagaagaattggttttcgtggactatagtcgcgaacagctcatccaagcattgcacacgccatcacctaagaaattgaatttgtataactgattaaacgaccgattcgcgactgaatcggtcgtttttctatatttttcaaatatcagataattatttgttatggtgttagtcactaattttcccaaaggtaacccatgcagttttatactaatagtaaattgaataggttactgaaattgcacacggaattgtaacgggggaaacgatacaatggcagagaagttaacgacgcaagagggacagccttgggcaaataaccaacacagtttgacggctggtcaacgcgggccagtgttgattcaagactaccaactacttgaaaagttggcacattttgatcgcgaacgcattccagagcgtgttgttcacgccaagggcgctggtgcgaagggtgtcttccaggtgacgcatgacatgagtgcatacacgaaggccgatttgtttaacggtgaaggtaaggaaacgccattggcaatccgcatttcacaagttgccggtgagctgggttaccctgacaccatccgcgacgttcgtggctttgccgtcaagttctacacagaacaaggtaactacgacatcgttggtaacaacacaccaattttctttattaatgatccattgaagttcccagacttcatccactcacaaaagcgtgacccacgtagtcacaaacgtgatgtaaatatgcaatttgatttttgggcacattcaccagagtcaattcaccaagtcacgtacctcatgggtgatcgtggtaattcaaccagttatcgcacaatgaacgggtatggtagtcacacctacaagtgggtgaatgcttccggcgagcaattctgggtgaagtatcactttatcagcaaccaaggtgtgtcaaacatgaccaatgaagttgctgagaagttagcaggtcaagatacggattatctacaaaatgaattgttcagcgcaattgaagatggtaattacccttcatggacgctatatgtccaaatcattccttaccaagaaggtttggactacaagtacgatatttttgatgtcacgaaggttgtgtcacacaaggattatccactccaagaagtaggtgtgatgacgttgaatgccaaccctgataactactttgaagatgtcgaagaaattgccttctcaccagcaaatttggtgccaggtatcgagccttcattggataagttgttgcaaggacgtttgtttgcatacaaagatgcggcgcgttaccgtttgggagccaactatgagcaattaaaggcgaaccggccacgtcatgaagtatacaactacgcccgtgatggcttcatggcacaaaaccaagatggtagtgtgaactatgagccaaatagccagggtggaccagttgaagatccacacgcatcaatcagtggtgatatgttccaaggcatgactggggcatacgaaccatatgacacggactactattcagcagccggtcgtttgtacaacttgatgtctgaggaagagaagcaacgtttggtggagacgttcaagcaaacgttaggtaccattgatagccttgaaaacaagcgcttgatggtgcaacaaatggcgcgagctgatgctgattacggtcaacgcgttgctgatgccgttggagttgatatggcagatatcgaactataactgaatcatgatgaaacgcaatggacgaaatacgttcgttgcgtttttttgatgcaaaaacatccgataaattggtagtgccggaaggaatgttgggataaccgggatactagttaagaatttcacgaaacttgaaatatcataaaagaagttcgttttaaggcgtgataaattgggattgatggtaaggagagaatcatgacgaagtcgaaattatggcgattgattaccttgtttttggtgattgaaattgtgagtcaaagtacacacatttttggaacgaactttcatcttgccgcgcgacacacgatgttagcatttatcgtggtagaagcagcactagccggacttaccttgttgttgaataaacttttaactcaggtacaagtgccgtttgaccggcagatgactgttccacagtcatcgtatttattgtttccagggttcttattcttaatgatgacactgggcacgttgttcagcgctgactacaccttcaaaggatttgtgatggcggttgttttgacgctattagtggcattctttgaggaatacttatggcgtgggattattttgtcggtggtgaagcaatacgttaagagtgaactagtactggtagtcggtctgggggcgctgtttggattgtggcacattaccaatgctttttcacagccttggcatgagactgttgtgcaaatgattgaaattgctggtttgggtatgctgcagacagcactgatgttgcgaactaagaacttgctatacccgatgataatgcatgggttactggacttcagtggtattttacgaaacatggcggagccgcatggtattccttattacgtcgctgtgattgtgttcgctagttatgccgtaccggcactattgtttgtctatttgggtagcagaaaacatgaaggaacgagtgatgaataaacaattaacgggttttaaagggctgctgtatatattggtgctggtgagtgtgtggccgattattttagacgtgattcgtggcgataatatttggcaagggtatccttggggtgttgttgcgacggttgctgcagctttcttgtacttaacgaagctgaatgaggtcttgctgacgttgttaatttatcttgcctggttggttgctattattgtatttaaaaatgatcttatttttccgaaattcattattcaggcgatcttggcaggattcatgacgggattttctgccatgcttggcgtttatgctaaggctcatgggtaagagagtagtactttaagtttcttttattagagaaggcgtaattgttttgtagggggaaaacgatatgcggaattttttaagtgggttgtggccgattgttgtaggattaacgattggacttatcggggttaattttgtagctagtccggtgactatttcaggcgattccatgcagccaaacctgcagaacaatcaaatagtgatggtgaataaacaaggcgagataaagcggggcgaagtcgttgtatttaatgcgtatggtgtcgaccctaatgccactacgcctgatgaaaaatatattaaacgtatcattggtgtgcctggtgatacggtgtcggatgtgaatggcgtattgcgagtgaatggtaaggttgttgatcaatctttcattagcgaaaacgaacaggtcgccacgaataatcgtgttggtgattggacatcactagcagaattgggtcaatcacaaaactggcaaggaccaattagtggtaaggttccagctggatactattttgtgctgggcgaccatcgtagtatttcaaacgattcaaggtattggggatttgtgcctaagaacaagatttctggcacagtatgggcgccgccatttgataatgacgcgacagaagtgaataaggtgtctttctaatatagacttgatggtgcgcaatgagctgaaaactcgttgcgctttttttatcgccgattatgctacgattaacaaaaatacgcgagaggtgacctgacatggtgttgattattattatcctagtccttgtcgtaattgtcagcgtggcagcgttttctgacgaatcggatcggacgattgactgggaagatatcgaacgttgggaacaagaccgacgtgaccacaaacgtcgtaatcgttaactcctttttagtttgtcatttgtgttacaaaatgtaataataatgacatattaaaactgttgggggattgtgacatgaagatgtggcaacgaggattggttgtaacaatggctttggctggccttggtggggttgtaacgccaggtgcagtggtatttgcggatgaagcagtgtcagcgacaagttcgtcaactgcaccaattcaatcggatactgatttgacgttggctggggatgctatcgctgtgcagaagttgaaggttggtaagaccatggctgccggcacgacgttggtgaagatttactacatgaaacctggtactgtgttgcaactatcaggtccatatacggactttggtggttacacggtaacgtcaaatgaattgccaaagattaacacggacaagtatgtgtacgttgtgaacgatgagggcttgtcacaagacgggacgacgttgaaccacaaggatccagagacgaagatgtcaaaggacgagccaaagttcagcaactatagcaagaagtgggctaagaagttgtcgaccaaggaagttaaggcaattaatgagtacagcaagaactacggcgatatgaacaattggttgcgtagtttggacaagaaggcttcttcgaagacgaagaatgagattaagttgattgattcatcattcaagaagttcaagaatcctaagaccacaaccgtttggcgtggcctttcaacggacggctttgatgctggattgaagggcaagttgaaggttggtgcaacgtatactgataagggatacatgagtgccacattcgatcaagaaatcgctaagaagtatgcaacgggtatcgtgcttcaaattgcgttgccaaagggtaagagcacgggtgcttacatcggtaatttgtctgactggaagattgaaaaggaataccttattaagcacggcagccaattcaaggtgacggcagtagatgatttaggtgataacaagctggttagtttgaagtatgtgaagtaatggaattgaggtcgttggtgtgattaccaacggcttttttggtgtcgctttttcagttggattaacaaatttagcgtttctaaaatgcactcacagtcatggtttgggcagctttaacaatttatggccataaaatcagggttgcttacttttttgaaagcggttacaattagtacgtacaaaaaaggaaccggttccaaaattgatattgaggggaaatattatgaaccacgaagaggtagcaaagcgggttgcgaaggctttgggtgatgataatgtcattacggcagcgcactgtgccacgcggttgcgtttgattgttaaggatcgcgacagcattgatcaacaagcgttggataacgatccagatttgaagggaacatttgattcgaacggccagtttcaaatcattgttggaccaggggatgtcaacaaagtttatgatcattatgtgagtcaaacgggtgttaaaacagcgacaccggaggagcttaaagaacttgccacccaacaaggcaagaaaaagaatccgattatggcaatggtccaagtgttatcggatattttcgtaccattgattccagcaatgacggctggtggtttgttgatggcgctgaataatattttgacgggaaaggacttatttggaccacaatcgctggtccagatgttcccgcaaattaaagatgcagctgacatgattaacttgatgtcttcagcgccgtttgcatttttgccaattttgattggttacacagccacgaagcgatttggtggtagtgaaatcttgggagccgttgcggggatgattttagttatgccggctctggtaaacggtaacgatgttgcgtccgttgtggcggctgggaagatgccggcgtgggatatatttggcttgcatattgcacaagctggatatcaaggccaagtgttaccagttatcggtgtggcgtttatcttggcgaatattgaaaagtttttccataagcatttgaagggggcaatcgatttcaccttcacaccaatgtttgccattattattacgggattcttgaccttcaccgtggttggtcccgtcctacgaacattgtcaaatgggcttactgatggtttggtgacgctttatcaaacactcgggttcattggcatgggtatttttggttccgtttattcagcaattgttgtgacgggattgcaccaaagtttcccagcaatcgagacgacattgctcgccgatattaccaagacgggtggagatttcatcttcccaattgcagcggtttcaaacgtcgcccaaggagctgcggcatttgcggtgttcttcttggcaaagaaagacgagaagttgcgggcactatcgtcatctgccggggcttcagccatgcttggtatcacagaaccggccatgtttggggttaatttgaaatacaagttcccattctttattgcccttggttcagctggaattgccggtttggtgattgggctgttccacgtgctgtcatcgtcattgggaccagctggggtgattgggttcattgccattccggcggccaagtgggttggcttctttatcagtattgcattggcgttcgttctggccttctcagtcacatatctttatggtaagcgtcatcgtttcggcaatgatgccaccacaaacgaagcgcctgtacgctacgaacccaaggcgggcgacgttgtagtagcagcgccagttgatggtcgggttgaccgactaagttcagttgatgatcctgtcttctcaagtggtgcgatgggtaaaggtgttgcgattatgccagaggctgggcaagtatttgcaccggttaatggtacggtaacagttgtttatccaacaggtcatgcgtacggattgctgggtgatgacggtgttgaaattctgattcacatcggagtggatacagtctcgatgaatggcgacggttttgaaacggtcgtaacgcaaaatcaacacgttcgagcaggtgaagtactgggaacgtttgatacagctaaaattaaagcggctggtttggatgaacatgtcatggtgattgtgacgaatacagcacaatatcacgacgtacagcagattgcgaaccaatcggtaacggcaggtgatccgttattggcagcccagaaggagagtatcgcttgattattggagatatagaaaaatttgaacagtatcacatttatgcagaacatggcttaattaatgacccgaatggtttgatttattttaacgggcaataccacgttttctatcagtggaatcccaacgcattggaccacacttataaagtttgggcgcacgttgtcagtgatgatttggtcaattggcgccgcttgccgattgcaattgcgcctagcttgcctgaagatcgttcaggaatttattccggcacaacaatcgaaaaggatggtcgactttacgcgttttataccgggaacgtgcgtaatgatgctggcgaaagcgtggcatcattccaaatggcagcggtgtctgatgacggggtccactttgaaaaattaggcaagttatttgatcaaccaagcgggtatacgcgtcacgttcgcgatccgaaggtcttcgcgcgaaacggccattattacatgttacttggtgcgcaaaagcttgatttaacgggtgatatcattgcctacgaatcaacggacttgcatcattggtcatttatgggctcaatcctgggtgatcaactatcggcttatcgtggttacatgatggagtgtccagaccttattacgattgatggtcgggatgtgttgatgttttcgccacaaggacttcctgcagctggtgaccgcttgcaaaatattcataacacgggttatgttttaggcgaatttgacgatgtaaatggcactttccaagtgacaacggaattcaaagagcttgatcaaggatttgaattttacgcatcacaaacgttgacgcatggtaatcgtcacctgttgtgggggtgggcagggatgatgccatccgttagagaaaagcaattaccaacgattcaggctggttgggcgcacgttttgtctttgccacgtgacatggcaatcgttgatggtgaattacgtcagtatccgattcctgaattgggtgacttccaacttgtgcacccagaagcagttaccgggctagggttgtggcgtttggctggcgataaatggcaggtggcattgacgtcgaagctatctatccagcgcaatggcgatatcgtaacgttcacccgcgttgcttgggagtctggtgagacggaagagcgacggacgaaagtcactggggatgtgcttctagttattgataacgatgttgttgaactgtacaccacatcaggcgacacggttatgacggcgagatatttcgattaaggtaaatagtattaaatagcgacgttgcggatgacgtcgctatttcttttgcgctcattcttgataaaatgaatacgaaagatacggaggggcgcgagatgagtgaaaaagaaagagtgaccattagtgatattgcccgactagctggtgttgggaaaagcacggtctcacgctatttgaataatggctcagttagtcccaaaacgcgggctaagttagatgccgttgttaaagaatatgactatgaaccaaatcgttttgcgcaaagtttgaaaaagacatccagcgggatgattggtgttgttgtgccgacgtttgcgtcatttgcgttaactgagatgatgcgtggcatggatcatgtgaaccaggatgatttttttctaacgattaatacttatcatgatgcgaagcgccaggttgaagcggttaagcaactggcacagcagaacgttgatggcattattgtcatgactgggcaagtgacggatgaaatggccgctgcgctggaacaagtctccgtgccagtcattgtgcaaggacagccgtcaacgcaatttgagacggttaatgttgataaccagcatgccggcgaactattggtgccattaatcgccgacgccgaaccaagtgatgtgttgttattgggtgttgatccatcagttgactacaacgtcggacaagtgcgtttcgacgctgtcatcaacgcattaaatggccaaatgaaacgggtctatacatcatttgatcgttccgaaacaattaccgttatgcgtgattatcttgcaacgcaccagttgcctaagtacattattgcggcaacggacatcattgcgttgggggctctggctgcagtacaagagcaaggcttcaatgttcctaacgatgttaaaatcgtggcttttgataattcaccggcagctgaaattgtgacaccagcattgacgacggttgggtttgattattttgtgctgggtcagtggttgtatcgtcgcctaaaagacctctctcaaccagaaccagttttgcatgatccaatgttggcaggaaccttggtacgtcgtacgagttggtaatggtggatccaaagatggcgctgccgtaaaacttgtgccgcgtaatttcaggtcgcatgctctaaaattaagttacaaacatctatacagagaggatgcgagctaatgaagaaatggattttatttttagtactaatcgccgcgtttgtgcttggcgcagtggcgtttttactaggtcgagattacaaccaaacattggtgaaggataagccaactagctcatcggtagccagttcaaagtcatctagtcataagtcatcaaagtcgtcgtcagcaacatcagaaacggtggcaattccaaaggcgttgaccttgtcaggcgcccaaacggatgagttcgcaaagtgggtcggtgatcaagctgagaaaatgcgtcttgctggttcagcactgaatctgcaggttgatttaccggatgctaatgatacagattctgtgtattaccagactgtaaacgggccgttgtatatcaatggaacaaacgccggtcgtggattgcaagctgagggaatctttgggttctatgtctgggatgcttatcctgttcaggattcaagcggcaaacagaattatgacggcacggtcggctatcaacctgcacaaaccgtgaagtttacgcttggtgcaaattatggtcatgttgctgatacaacgaatcattcaatggatatgtacatcgtggctaacgatggcaatatttatgagttcaagctggctcaaggtgcaagtagtttggcgccgttgtatggggatgaacatgcgtcagaaaatgacgtcgtgggacaagtcacgcaggatgaagcagcgaaggctgagctgaaccgtgttgtgggttatcaagcggacaaggttagtgagtcgtttaattattaataactagaagggtcgctaagttttttcttggcgatttttttatttatatgaaatcagcgattcctgaaaaatattgatttgcgtcacgtatttaatgggcatacaattaaactaataattggtcagtgacaggtatgaggggatatgagtatgacagcagtttatatatttatcggcattgtggcagttgcgctatttgtgggaaactacattatttatcgaaagcatgccacaaaatctctgaataagacgcaatcgttctttggtgcgatagtcatgacttttgcagatttgtttttctagtagctagttagatataaaaaacgacgatgtcaccatcgccgtcattacttatcctgaatcgtcgagatatcctcggcgattttttcttttagtgtttgtagctgcaactttgaaaggttcgctgactcaatcagtgacacaatcgcttctaaatcagtatccaaatccacaaaagctagtggtagcgtttcaacactgttgtctgggttatcagtattacctagtaggtagttcactgaaacgccgagaacattagcgaccgcttcaacgtgattaactgtcggctccttgaacttccagccgtagatagtattgtgaccgagcattgcagcgttgttaatcgttcgcaacgaataaccttgcttgtctgcgatttccttaatccggtcaaatgtgactgatgaaaagtttgccatggtaacaacttcctccgttgatctaattatgcaacaaatatcgtcgcggtgctagtcagggcacgtttttacgctacttattcgaaatagtgttaggcttgacgtaaataagaaaaaaaggctagaaaaatgaaggcagttgttctaaagaagctgggtgattttgcatcattaacagatgaaacggttcctgatttaaaggtgacagcagatgccatcttggttaagacacacgtggtggcagttgatccgattgatattaagattggtagtggaagtcgcggtggcagtgcgccaatgattcttgggtcatcagttgcaggtgaagtcattgcagttggtcgtaatgtgcatgacttcaaggttggtgaccgtattgctgccaatgtccggggtggtgaaacgtatgctgaagaagtcctagttcctactcgcttggcagcccgcattccagatggtgtgtcttatgccagtgcagtttctgtcgtgcttggtggtcaaactggttacagcggtatcgtccgtggtttgcaagttaaggttgggcaaaacgttcttgtgcaaggcggtgctggttccgttgggctgatggctgtgcagacagcattgcatgctggtgcgaaggtcagtgcgacagctcacggctggggcttggatttcttgcatgagaagttcccacaagtgacgacatttgattacaagacggatgacatcacggcgaatggtgcggtttatgatgctgtgtatgatacggtaggctcagaaaaggtgttagcagattcatttgcagcaactaaggctgacggacatgtgctatcaatcgttgcgcgttcgcaccgtgatacacgcttcgtgcacttcttcaatcaaccaacgggtgaaacggtacaaacgttgtgggatggtttgagtaacggtcgatttatggcggtagttgatagtgagttgccattgagcgctgataatgttcgtttggattatgagcgactacaaaatggtggcgtacatggtaagctgatcctaacgctgtgagataggcatagttatacacgtgagtttctatgacgatttagtttgaaacttaataaacgtacaaaaaagctaggttaccaattgcggggtaacctagcttttttgtcgaccgtgggttcggtccatttaaccattcacggctgattagcgaccactcgctgaaatcaggttgtagtcagcgctgacaatttgtatgctgtttacatagcgtggaggggaaatgatgttccgttggaaaaaacaaattgaagaaatctcattaacattggacgcacctgaacaatctgaaaaggttggacagttaatcaatgttattgaacgttttaatcagcctacccacttacgtttaaaaacgatgagtgggattgcaacgttagaattagaaacaatcatattgtttgatgttcagggtggcactttgactgttaaaacagtaaggggtgtgtacgaaactaaaacgacgctgcgaagtttgattaaccaactaccagcccagtttattcaaatatcgcgtaacacggttataaacatagaccatctaattgagattagaagaagttatagcggtaattatactggcgtattagtggctgataatacagttaatatttctagacgtgctgtaaaagcattaaaagaaaggttaaagggaggggaattatgaagtcgtggttaaaagtattgtatcggcatgtctttgtcggtatgggtgcatcatcaattggatttctatgcttgtttgcaggcataaattggcgtgttacaacgtatgatcagggtttcgcattaggagtcggcgcgttgatagggctattaacggtcctatttcatacaaaggttcctgatgtcatcgtgtggctccttatatgggttattacggttggcgtgtttatcgatgttacatcagtgtaccaactacaattacttgatacttggcaaatggctgcggttaatattggcgcactgacgtttatatggctaggactttttttactcaatcgttgggcttttgataaagaagttactgaggttaaccaactattaaaacatcgtcgaaattatttgaacggtgaaaaatagcgatggcatatttaacgcttaatcgggtgtcaaaagtgtttaaccgcaagacaatcgtgcatgatgtcaatcttagttttgaacaaggcgaacgggtagcgctgctggggccaaatggggctggaaagtccacccttatccgaataattgctgacctgataaaaccggaccgtggtaccgttgttcgtagttggcgggaaaatagtaatctggggattatgccacagcaagacatattaccggatgatttgcgagtcggcgaaatactgcaattagcagcgttagctaagaatataaaattagacaggaaacaggtagatgaatttttaggcacgagtttatcaggcaaggagaaagcatttgctagttctttgtctggtggtcaaaagcgacaattgtcatttttactaagtaaactagccgaaccaagtttcttaatattagatgagccaacaaccggcatggatttagaaacaattgaaagaatgtgggaaagtttgatggggttggcggtcacgacattggtcgttactcatgacttcaatcaaatcgatcagtacttcaaccgggtaatcatccttgataaaggtgaaattattgcggataagcgagttacagacattcacaaggaaggcgctacaattgctgatttctatcaaatgaaaattggaggggaaaaaggtgtttcagattcaattacggtcagtgctgcgaaatattagatttgtaatattcactttgttactgccgggcgtttggtacgtgctttttttgaatgtttggcgtgatacgccgcttccatctatctcattactaaccatcgcggcgttaatgggaattattgggaacagtgtcgtgactttttctaaacgagtcaatatgaacagaggattttttcaattgctcgatgcaacgtcatcttacagttcgcgtcgctttctgcaaacacaagctgctattcaaataacacttaattttgtgatatatagttggttggtattaatcggtattgtattaaataaattaacgttatcgatagacttaatttttgtcggtggcttggtatcaatattgggattgtacttttcggccattggttttgtggtggcgatgaaattttctggtaaaacattagatacattgagtttcccaatgactgtggttgctggattgatgattgtgccgtttcaaaactttccacagcaaggggttattaaacaactgacgttagtcgaaaaatttttgccggggtattggttcaatgaggtgtctcagaaaattggtttatcacaacattttgaaatgcctttattgcttatgatgacgtctgttctagtaacgttactaatggttgtatctttgcttaaaggtaaaggttcgaaaattaaaattagattatagaaaatgttgacacttactaataataaagctatactcatgttcatcaagtgatgaagaaataagtattagctggtgagttattcagagagtcgatggttggtgagaatcgataacaagccactaagaaaatggtcttggagctttatgcatttgcgagcgcaagtaagtgaatgccgggtgcgcccgttatcgcgtacgagtatatctggaggctgcatcagctggaaggcgtactttttgagggtggactggcgacagtctatcgaatctgggtggtaacacgagttaattcgtcccggggatgctaatggtagcgtccccgggatttttatttggaggaattttttcatgagtaagcatttggttttgcaaacggattttggtctacaagacggtgccgtatcaacgatgtatggggttgcgtatcaagtatctgatgacattgtcgtgtctgatttgacgcacggtattacgccgttcaatatttttgaagggtcattccgtttggcacaaactgtgaagtactggcaaccaggaacggtgtttgtatcagttgttgacccaggtgttgggtctaaccgtttgtcaattgtggccaagttgaagaccggtcactttgtggtgacgccagataacggcactatcacacatttggctgaactatacggtattgaagaaattcgcattatcgacgaatcaattgatcgtttgccgggttcagaaaagtcagcgacattccacggtcgcgacatttacgtttataacggtgcgcgcttggcgtccggtgaaattatgtttgcagaaatcggtgaggtgttgccactcgacaaggttgtcaagttgccattgcaccttgctaagtttaacggtgagaccattgaaggcaatattgatatcacggatgttaatttcggctcactttggacgaatatccctgaggaaacttggacaaatgaattccacgctgtgcaaggtaagcaatatcgcgtccgtgtttatcaccaaggccaattgcaatatgaagacacattgccatacgtgaagacgtttgcggatgtgcaaccaggcgaatccttgatttatatcaactcggtttacacagtcgctttggccgttcacaccggaaacttttcaaccgcccacaacgtcggtgctggacctgattggtcaatcgacattacaccagcaatttaggagaaaaatattatgaagcaacaaaaaggactttcaactcgtgcagtcgtcgcaaccggaattggtgcggccgtattattgattttgtttaaattcgtggcgattccaactggtattccaaacacgcaagttaacgtggcacaagcttgggatgcactggtaacggccatcttcggaccaatcgtcggggccttggtagccttcatcgggcacgctttgaacgatgcgatttcttacggttcggtttggtggagttgggtaattgcggatgccgtatttgcattggtattcgggtttgccattaagcatttgcaattgacgaatggtgatttcaccacgcgtaaagccgttttattcaacgtttggcaattgattgggaatatcgttgcttggagcattgtggcgccacttggcgatatcttaattttcagtgagccggcagccaaggtgttcctccaaggattcgtcgcaactggcgtaaactttatttcaactttgattctgggaacgattattttggccgcgtacaacaagacgcaagtgaagcgcggttcgttggctaaggaagattagcatttcggcggggatacccgtcatacatatatttagatttgaaatgaggaaaagaacgtgacagcagcattagaatttcaacacgtgacctttcagtatgatgcgcaggcggcgcccacgttgcgtgacatcaacctaactattcagccaggtgaacgcattttgattgctggtccatctgggtcggggaagacaacgttaggtcagctgatcaacggcttgattccgcatgcctatcctggtgagcttaccgggaagattttgattaatgggcaagatgtgaccgcagcaagcatttttgaacgctcgttctctgttggtacagtcctccaagatacagatgcgcaattcgtcggcttaagcgtcgccgaggatattgccttcgcccttgaaaacgataatgccacgcacgacgagattattagtaaagtgcaacgctgggcagatgtactggatttgcaaagcttgctaacgatagctccacaacgcctgtctggtggccaaaagcaacgcgtggctatggctggtgtgttggtggatgatagtccaattttgttatttgacgaaccgttagcaagtttggatccggccagtgggcatcgcatgttgacgttgctggatcaattgcaagcagaatacggtttgacggttgtgatgattgagcaccggcttgaggatgtgttgcaacatcacctagaccgcgtggttgtcctagaagaaggtcgggtgacttttgatgacacaccggaaacgctgttacgaagtaatacattgcatcaatacggcttggcggttccaggttacttgcaagtggtccaacaaacgggcattgatttaaatgcggtgactggtattcgtagtccaaaaacaatcgatggcgtaggccttggtgaacgactcacgcagctagcattgccgaagattggagcgactgaaaaagtccgaacggcgttactaaccatcgacaatttgtccttcaattttggcgaccgtgcgctgtttaatcagctgtctgccgaaatttatgacggtgaattggtagcattagtgggtaaaaacgggtctggtaaatcaacgctcagtaaattgattgccggtttcatcaccccaacggccggcagtatgtcattggctaatgtcggtgatttaggcgcgctatcaattaaagagcgcgcttcctatttcggttatgtgtcgcaaaatccaaacgagatgattacgcaagccattatttttgatgaagttgccagtgggttgcgtctgcgaggtgttgctgaagaggcgattaaagaacaggtgaatgaactgttgcgcctggccggattgtatgaaatgtgtaactggccagtgacggtgttgagttatggccaaaagaagcgcctaacgattttgagcgtgctggcacttcaaccgcaagtattgattttggatgaaccgacagcagggcaagattatgcgaacgcgcaagcaattatgcagtttgtccgtcatcttcatgatgagttgggaacgacagtgattatcatcacgcacgatatgtcgttgatgttgcgtgttgcagaacgcgcgctggttttggttgatggggaattgattgccgacacgacgccagcaagattgttgacgaatgaggcgcttgttgagaaagcggccttgcatctcacaacggtttacgacttggcacaacgatttagtttggctaatccggctgcgttgacgcaattgattgcaggagaataagagagtatgaatcaattatttggttatcgcgcaggtaactcgtttattcaccgattgaccggtggaacgaagctcctcacgcttttgattttgaccatgagcggcatggtgagttttgatttgcgttacttgccatggctgacgatgacgaggcgattttgaaggcgcacccagttgacttcttgagcttcagttactacatgtcaacagtgacttctgccggtgatagtgaagcggatgcgttgggtaacatggctgttggtggtcgtaacccatacttggaagcttctgattggggttggcaaatcgacccaatcggtttgcgcattgtcttgaatgagatgtgggatcgttaccgcgtgccattgttcatcgtggaaaatggtttgggtgcgcttgatgaaattgcggccgatggtggcattcatgacacgtaccgtatcgactacctccgtaagcacatcgagcaaatgcgcgaggcaattatcgacggtgttgatttgatgggttacaccatgtggggaattattgacttggtgtcattctcaacctcagaaatgtcaaatcgttacggtgtggtatacgttgatcaagatgatgccggtaacggaacgctagaacgtaagaagaaggattcgttcgagtggtacaagaaggttatcgcgacgaatggtgatgatttaaattaacgatggagcgtgtctgccagatggcgggcacgtttttttggtagaattttagttaaagggttttggggaggtaaaacatgagtaagacttatcaagaatttgtagaggcacgtaagcgtaatgaacgcaaaatgccgtttgcaccagtggtaaccgggccacttttgtttccgtttttcaaagacgtccttgaaccggtgccagaagtaatgatcaacgatgacggtttgccagtcgttgtgactaaggatgatttgttgtactttttgaagcacaatatttcgccttttgtgaccgtggggatggcaaacaagacgatgtgggaagcgatgaatgccattaaagcagcgtcacattcggattgggcaaagagtggacctggcttatttacattgccaactcgtttcatcgaaaaacgaatcaaacagtcagtaatgctgaggcttgctcgtgataaagagtttgtgacgcagattggtaagcttgagaaaattacggctgagtttggggagggtgaaccggataaacagcctgaacagactacttggtatttaggctaattgtgtgagtgatttaggtgcatttttaagcttcatcacgtaagctatacctatacaccattgagggggactatgataatggcgaaaatgagtgatgggtttcaatctttgaagcaaagtgcgggccgtatgggtgagtcagtgaaggcgaagacggttgaaacacgcgtgaacatgattgtgaatcgcaagttgcaacaaccgttcaaggcgttgaagcaaacgcgacgggtggcaattcagcagttggcggagttgtataagaacaacaaaatcagcaccagtgaattcgatgcagtggctttgcaatatgaaacgcagttggtggcaggtgcgaatgaagcattacgcaacatggttgtgtcatttatgacggatgaagcaacgaagcaattcgactttgactcagatttgattcacgatgtgcaactgacaccgatgacaccggccaagtacgtgaagattacaccgaatgcgaccgcgaacgccctgagcaagcaatcaaagcgtgcgatggttttgcaagctggtacgatggctgctcgacaagctgccaagttgcgcaagacagctgctgcaacaccaaagaagggaaacccaatcgtgaagaatgcggctgttgatctggcagtcgctggggttggttttgccattgatttggtagagagccaagtgatggcacgcaaacagttcaaggtatctggtctattaacggagtacgaacaagttttgcaacaggttgctgagcaagtcgaagtcttcaaggctagcctgcaggtggttgatggtcaattgaagttgttgccattggcgcaattgattgacgatgataatgatgaaatttaattaacgttttaggagttgctacggcagctccttttttcgtcactgacagaaggtgtgttctggagggaaatcaaatcaatctctgagtgtgattccaatttttttcactagtgcctggtatgctagttgaaaaatggaggtttagcaatatgtcatgggtagtctatctcattgcgttaattggttttattcggagctgtacatcatctgatcagctgccgccgattatcgtcgtcttttttgtcctgttgattatcaagatatttaccggtagcttcctagccggcttgctttactggggttttgttatcgtgaccgcttttgtgttagggatagttggtcaaatcattggcgttatcacccttgaaggggatgcattaaatgtgcagatgcatggacttctgatactgtcgatgattattgtggggtggtatggcctgaaacttatgctgactggcaaaattggtaaataaaaaggaagtaccgattcggcacttcctaataattgcaatttactcggctgcgttgtaaccatcaatgatggcattcacgttatcgacgttttcagcgacccagtcagccaatgttgatgtggtgtacaagcggttttcagtgtgatcaccgtgtagggaatcaagcaccaacgtttcagaatcagtgacaaagcgtccgttgaacactgcttcgtccgtgtgggcaattgcaccaatttcagacaaagcaacgaacttgtcggtaccgttaaattggttcagcggcgttagacccatgaacaacaagccgttctcttcaaaactaatcacaaaattcttacccgtgaaagcgttgaaggcaccgattacatcttcaagcttgtggttggcttcgatgtaagcaacgttggttgtgtcagcggggtaacccaattcttgtttctttgcggcgatatccgcagcgttaaaagcacttgccatgacgatctcctaaaattttgatgcaattagtttagcataatgcccggtatgactgggttgaaaagggaacttgctgttttggttcgccgatatgtaaaaaatagtgattgtatttgctggcaactctgttacactaatcatgaattaaatattcaccactgggggagccatttggctgagacggtatgaccggaccctttgaacctgttgagttaagacttgcgtagggaagtgatggtagaccgaccagataagactatccaatcgatcaatccgtttctttatacgcgggttggtcgatttttttgtctattctggaggaattatgaacactttactgaccaacatccgtgaacaacaaccgctggtgctaaatgttgcaaattttgtgacgatgcaacacgtcgcggatgcgattaacgtcgtgggcgcttcgcctttgatgaccaacgaaccacaagaagccgctgaattagttggcatttcgtcggcggttgttttaaacattggcacgctatctgaagcgcaatggccactatttttggcagttgggcaagcggctaatcggcaaaataagccagtcattttagatccggttgcggtggggatgccataccgcgcacaatttgcgcgtcgcttgctggaaaatgtgcacgtcgatattatccgaggtaacgctagtgaaattgcgtggttcgcccaggtggaggttgcggggcgcgggattgatacccttgaccagacaacgcaccaacaagaagctgagttagctgctaaaaataccggtgccgtaattgtacaaactggcgtggttgacgtgattaccgatggtgtgaaaacgcagacggtgcataccaactcacctttgttggcaatcaacgttggcgctggcgatatgttgagcggtttgattggtgcgtttgctgccgtggcagatgactactttgcagccggggtcgcagcgactgaattgtttggtcaagctggtgaacgtgcgtctgcacaagtgaatcagttaccgggccacttcatcggggcattgttcaatgaactgtatgcgatgactcaagtggaggtgactgcacgatgattgatgtgacacaagtactgactgtagcgggtattgattcaagcggtggtgctggcgctaatgctgatttgaaaacattccataatcaaggtgtgtatggcgcctctgtcattaccggtttgacggcgcaaaatactttgggcgtacaaaacatcttgccaacaccaactgattttattagtgatcaattcaaaagtgtcttgagcgacctagatattcgagcgttaaaaacaggtgcgttgtttgatgccgaacgggtgcatgtcgttgcggacgaaattgcgaggtccggtgtgacagatgtggttgttgatcccgtgatggttgcaaaaggtggcgccaagttgctgactgatgatgccatcgaagcggttaaaaacgagttgtttccgctagcgacggttgtgacaccgaacttggctgaagcatccgtcttgttgaaccgtgcaattgaaacgatggatgacatgatggttgcagcgtatgacttgcagcaattgggtcctaaaaatgtggtgttgaagggtggtcatttgaaagacagtcactctgatgatgtggcggattacgtggcgtttgccgatggcacaggccgttggtatcacgcgccacgcatcgagacgcaccgcacgcatggtactggcgatacattgtcggcttttatcacgtcacatcttgcgcaaggtgaaacgttagtcgacatcatgccacgcgccaaggcgtttatgaacgctgcgattgctgaaaccattgccgttggtcatggccacggtccactgaatcattgggtgacaggatgaatacagaatttttacaacgatattttgttgccggctcacagaactttcctgatttaacattgcctgaatgcgaaggacgcattgcactgatgatgcaatctggcattacagcttatcagttccgtgaaaagaaccccacgttgtcgactgatgaaaaacaagctttggcgatgcggttgcgggcaaaggcacgtgaattagctgtgccgtttatcgttgatgacgatgttgcattggcaatagcaattgaagcggatggtattcacgttgggcaggatgatatgccaattacggatgtcgtggcgcaagttgccgggcagatgattgtggggctatcggttcgcaataaggctgaaatggtcgctgcccaatcggtgatgggaattgattatctgggcgttggaccggtttttgcgaccacaacgaaggctgatgcagccgcaccactgggcttagacggtctcatgacgaccttgaacgctaatacaaaacagctgccaaccgttgccatcggtggcattacacttgaagacttacccgcattacatcagtcgggcgtcgatggtgttgcagtgatcagtctattgagcgaagcaccagatgttcgtacggtgattgatgagatgaaagaacagtggaggacgctatgacacgtgaagagttgatgccaattcgcgacagtatgatggccacaattatggcagaaccatttgtccaaggtatccggaccggtgtgttatcacaaaatagtcgggattattatgttgcgcaggaccatcattatgtcgatgtatttatgatgctgttaaatcaaacgaatgcacaattgccattagaactaagacgaaatgttatgtctgagtcagatgagggcgatgcacatttggggcttgcaccaagtgagcgctaccaccaaattgcagtaggtacgcataatgcgaactatctcaatcatttgcgagagacagtcgcccaaggtgatccgctggccagcatgttagcgctgttgccgtgcacagaatcatatggtttgattgcacagcgtttgcaacagcaaggtgtcgcatcaaatgggtttaacgactgggtggattactatgcggacgcaacctatcagtcaatcatcgactggagttggcgaacggttgaccaactgtttgcacaaacacaatcggcaacggctgactacgccggcatttacgaaacgtcgtatcagcatgaattggcattttggcaggcagctaatcagtgacggggactgcctgaagcaagtcatcccacaaaacggtctacagaattcggcggtgagtcaagaattacagatgaacattttggccgggtcaactatgatagtacttgtgagagagtttagttgatgtttgcattctcctaaactgtgatcttgtgagtgatgtgagttactcataaaggcgcgcttccattagcgtgccttttttgcatatgcaggtataatgaaggaaagcaaacaaatggaggggaatatgaagacaattgtgattactggtgccagtgatggtatcggggccgctgcggctaaggaattggttagccttgggcatcaagtggtgattgttggacgcaacccagaaaaaacagcgaaagtcgcgactgaacttggcatgccatatcatttggccgactttacgaagttagcggaagttaagcgtttggcggacgaactacgtcagtatgaccacatcgatgtgctggcaaacaacgccggtggcatcatgggtgaccgcacgttgaccgccgatggatttgaaaagacgttccaagtgaatcatttggcaggtttccttttaacaaatctactattagaaaagttgctagctgatcatgcgacagttattcaaacatcaagtattgcagcaaacttgtttgtgaagacgtttgatgttgttgatgtgaatgttgcccatgactatacgtcagaaaaagcatatggttatgcgaagtacgaaaacattctattcactcgtgagctacaacgccgctatggtaatcagttaacggccgtcgcattccacccgggtgtggtgcgaactagtttttcttctgaatcaaatacatttatgcgttggctataccgcacgccattgaagtacctaggcacgattagtccagaacgcagtgccaagcgtttggtgaacttggctcttggcgtacctggtactgattttatagctggtgaagtatacgatgggaagaagttgcttccagtcaaagtggcagatgacggtaatgcgaatgcacgtcagttgtgggaagaatctgccaagatggtcgcacggtttacttctatatagaagaaacgaggttatgatgagtaacaagcaaatgattttctggggaccagaactactaaaagtgacggcactcggtttcttggatatggcggatggacagttataccgtatggctgaacgccgtttggcatttcgttctacgccaaatgctgtcgtggcgactgctgagggtgtgacgacagacaacccgcaaccattaatcgtcaaagagtttacggtaactgaggaacaagttcatgaaatcaaggcgctactaccagagtttgatgtgattgatgtgatggggatgctagaactacaagcgcatgttacggaagagcaccatgagatgaagcagagttatattgctgattttaaagaaacgtttgaatcagagattggtcaccgtgacttcgcggcttatttacgtgatgccacttatcgctatgccgattaattgagagatgaggaagagaatggaaaagaagaaccttaaactggggatgacaatactagcggtgttgttatttctggtcgcaattgtcgtgatgtttgtgacgcatagtaaagaagtcacatctgggctcgtttttatcggtctcgtaattggctactatgcggcaaaggttaaataaggagagatagataagatgtatttcgactttaagatggtagatcttgcggacggcatgcaagaattgcgtattgcgcgtcatgagggcgtaccaatgacgcagcatacccgcattgcgctatcgcaaaaattagcaaagacattaggatttgactatcgttcactaccgatgttagctgcacctgatgtttcggcctattacgcggtaacatcggaaaaagcatccggtgacttggaagtcattatgcgtaatgcaatggataatgaaccagaagcattcgtcgttgctgattgggaatcatatctagagaatggcgaaggcgagttcggaccattcttgtttgccatgtttgatgaatggcttcatgtaccagaggcacgtgacttatatcaaatctcaccattggaattcgagaatcagtctagtggaccgtgggcattctaccaagcgccacgcgaagtgacgaagcagatggtggcagataaccgtgacttcgacagtgagttacgccgtcgaatcaaggaaactgtgaacaaagatttgtattacgataagtaagattgcggttgtccctgattagggataaccgtttttctgttttatggggtgaatgtgttgacgttttggggtaaataagagtagtatatctaagttgtcttttgggtgtttcacccacgtccttatcggttaagaaaaagggtgttgacaatatcaaatctcttctgtaatatatattaagttgtttcggatgtatgaagaattcatgaacaagcaatgaaaaagaattgaaattgattgttgacaatcgcatttctcttctgtattatagattaagtcgtcaaggcgacaacgtaggtcattgaaaactgaatatcgtttcgatgaaacaaatgtgtagggtcatcaagttagttcttgatgcaaaaacatttgcgaagtcaattcgctagtaaattcgtttaacttctgttaaacaacaaaaattgagttaggcggaataggcagacgcgctggactcaaaatccagttcccgcaagggagtgtgggttcgacccccaccgacggcataatctaaagaccttcgggttacaagtaagacgttcgagaaatcgaacgtcttttcttttgcatctaacattccgataaatcggtattattttcgatagttgactattattacttgtatagcgctactcgctgtcttttataggggaactttttcttttggcttgaaaacaatgataaattgtaggagatgggttgtagtggctcggttaaattattgtcataagctttcaacagccaagttggacgaaattctttatgacttttatttagcatttagcatacgaataccactaaatatttagcgataagcgtaaaactgaatagtactgagaccgcaatccaaattgataatttggaggttttgtcatggaaaatgtgacaaacggtaagaacgggttgattcaaaacgccgcagacgatgccagtttggcagaagttaacgggtcaattgtgccgccaaaaaacggttctttttggcgtaagctctgggcgttttctggaccaggtgccttggtggcggttggttacatggatccgggtaattgggtaacgtcagtaacaggtggtgcaacatatcactacttgctattgtcaattgtgttgatttcatcattgattgccatgatgctccagtatatggctggaaagatggggatggttactggtgaagacttggcgcaagcaacacgaaaccgtaccagtaaaggtggcggtattgcgctatggattattactgagttggcactgatggccactgatatcgccgaagttatcggtggtgccatcgcgctccacttgttgttcggttggtcaatgattgtatctgttttaacaacggcatttgatgttttgttgctattgttgttgatgcgttttgggttccgaaagattgaagcgattgttattacgttgattatgacaatcttgtttgtattcttgtatcttgttgtcctatcacgacctgatattgcagcgatgtttggtggttatttgccaaagattcaagctgttaacacacatggtattgcgggcgcagattcaccattggttatgacgctgggtattattggtgcgacagttatgccgcacaacttgtatttgcactcatctatcgcccaaacgcgtaaggttaaccgcgagaacaaggaagagttaaaggaatctgttcgctttatggcttgggattcaaacatccaactttcaatggcgtttgttattaactcaatgttgttgattttgggggctgcgatgttcttcggacacgcagattcagttggtacgtttggtcaaatgtacaatgctttgggtgataagacgattgcgggggcgattgcatcaccagttctttcaacattgtttgccgttgcgttgttggcttcaggtcaaaactcaacaatcacgggtacgttgaccggtgaaattatcatggctggattcttgcacttgcgcgtaccaatgtggttacgtcgtgtcatcacgcgtggcttggctttgattccggttgttgcctttacactgatttacggtggtgctgaagataagctggatcaattgcttgtgtactcacaagtcttcttgtcagttgctttgccatttgcgatggcaccgctcatttggatgaccagttcaaagaagattatgggtgaagagttcatcatttcaaagtggatgacgattgtcgcctggttggtcttcttgttgttgactggtttgaacattcaattggtaattcaaattgtgggcaagttactttaattttcgggggataatgaaatggctttggaactatcagatattcaaacagcctaccaacatgttttagttggggttgatgaatcagaacaaggacaagttgcactagcaagtgctgtccatcaggcgctagaagatcaagcgaagttgacgattgcgactgtgttggaacttggggatctttcaacaacagacgtcttaagcttgtcagctgtgaataagcgtcgtgaagatttagaaaagaacttgcaagcgtataaggcatacgctatcgagcaaggtgtgacggaagtcgagacggttttggcggatggtgctaaagctggtgaagtactagcaatggaattggcacctgagattaaggctgacctactcattgtcggcgcgcactcaaagcaaggtatgtggccatcattgggatcacaagcggtgtacattgcgcgacacgctaagatttcatcattgattgcccgtcgttagacaaggttaagcgcttttggttgtgtgtgatacataatcaaaggcgctttttagttttaaaacgaattagaaagtgaataagatggcaaaggataaacaaacattagcacaacgaaataatttgattcgtgcatccgtgatgggggcgaatgatggcattttgtcagtttccggaattgttattggtgtcgctggagcaacgacgaactcattcgctatttttatcgccggtttcgctggtgcgctagccggaacagtttcaatggcgatgggagaatacgtttccgtgcactcgcaaaatgatgcgcaaattaaggcggaagccgtgcaaaatgatgcattgaataatcgttacgacgaagaatttgcgttcgtgcaaaagaagtatgaagcacagggtatttctgaacacctagcaaacaaggcaacgcaagagatgatggaaaaggatgcgctggggacgacggttcgtgagcgatatgggttcacgttgcaccatgaaatgtcagctgtcggggcagcgattgcatcgatggtctcattcccgcttggatcaatgttgccaatgttggcaattaccttatttccaccacacattcgtgttgctgcaactggagtagccgttttgattgcgttggcgattacgggttattcagcagcgcatttgtctggggcaaatgagaagaaagcgacgctacgtaatgtcgtcgctggtgtgttcacaatgattgtgacgttctacattggaacgttgattggtcgataggaggagcgtgcaaccatgaaaaatgttaagacacatcaaacaatggaagaacgtttgaatgcgattcgtgccggtgtgctcggctcaaatgacggcattctaacagttgttggtgtactattttcggttggtgctgccacgaccaatcagttcacaattctgattgctggtttggcagacttgttggcctgtgctttgtcgatggcttctggtgagtatgcgtcagttagctcacaagcggacgctgaaaaggttgttgttgaccttgagacccaacgtttgcgcgttgatccagatggcgtggcaacagacattcgtcaattctatctagaccgtggggtttctgaagcgacggctgcagaaatcgcgatcgaattgatggccaagtcacctttggaaacgattctatcgacgaaatataatgtgcaattgggccactatgtcagtccttgggctgcagccttttcatcattgttctgtgcggcgattggtggggcgttcccattgttggcattgtacttttcaccagttcgttggcaattctgggcaaccattctagcaacaacggtagcggtagcactaacgggttacttgagtgcattgattggaaagggctttgctagccgagcagttaagcgtaatgtggtcatcggtttgctaacgattgccattcactacaccattggattattcttctagaaagataacaagcgctcgagaaaccgagcgctttttctgtgcgtgagatacaactgagatacaaacgtgaggtatgatagactgtcattacgaatgagtgaaggaaggcagttgtcatgaagcgaacaattctaatactcgacgatagtgtgcgaattaaccagctcgtcaaaatgagtttgatgaatacgtatgatatcgtacaagcgttcactggtgaagacgccgttgcgaccttgcaatcgacaaagattgacttagtgttattggatatcacgttgcctaagatgagtggctatgatgttttgccgtatatcacggataaggaaataccggtcatctttttgacggctaaaactgaggtggcggatgttgtacagggcttgcaactgggcgcggatgactacatcacaaagccgttccacttggaagtgctgaagagtcgtgtcgaagcggtcatgcgtcgggtatacggccatgccgatgagattattaagtacggtgatttggtaattgatgtcacccagcaaacggtacgccgaaatggcgagttggtggatttaaccaataaggaatttgaactgctggtttatttcgtgcggaatcaaggggtgactttggcgcgtgaaacactgtatgaaaatatctgggattttgcggatgacatggtggatacccgaactgtcgatttgcatgtacaacgactacgtaaaaagttggacctagctgaccggattacgacagtgttccgcgttggttatcgaatggagacgctatgaaaatttcgattaaattgttcattgctttcattgttattttggtggcgtcactatcgatcaacagtgtgttggtattgcatcgtagttttgaaagtggcctgcaagaaaaggaatcaagtgctgcggtccttaataagcagacggcgcgacaagtgcaacagttggattatcaacaagataaaggtattaaagaagcccaagtcattaagttcgtcggcacgacgcaagataatgtgttgatttgggatgcgaagcaaaagttgatttaccatgaggacatggcagttaagcaagctaatcgtttgaaattgctagagggtgataaacaacagattcaatatttgctagatggtaatcggaagtgtgtcgtggcgacaattaaggtccagctactacgtaagacgtattacattagtacgtttacggatttaaattctgtttatgccgcgcaaaatcgcttgcttcgagatgtgcaggttaacttgttggtactgttcttagtgtcgacggcaattatttatgtcttaacgaaacaaatcttggtgccagttcatcaactacgtcaggctagtcggtcgtttcagacggatccgatgggttatcaacctttgaagccaatgcgtcatgatgaattaacagaattggtcaatgattttaatcagatggcgcatcaaattcaggcgatggtggcatctgaacgtgaaaatgcggcttttcaaaaagagtttgcgagtcatttaactcatgaaattaatacgccactgacgattattttgggttatgccgagcttatcgctgaatcaaacgtcactgaagaggtgaagcaagaggcggtgcgctatattgtggatgaaagtacgcgactaaagcaacttggtagccgtatcagtcagctgattcaatatgaccacgtgactttgcaacgcgaacccattagcagcaagatgttgcacgaaaaggtgacagatattgcgcttggcattcgacaacaaacagctcatggattccaatttgattatgcaagtcaggccgactatcgtttgcatacagatatgggcttggtttcagaaatgttagtcaatctgctggataatgctgtcaaagcattgccacagcaaggcggtcgaattgtggtggcagagaacttggatgaaacgggactaacaatcacaataactgacaatggtcatggattagatgaacaagccgttgatgatgtttttgaaccattcgtgacagatagcgagctcggtgaagatgatcatcttggcttagggctgtcgattgtcaaaagaattagtacggctttggggtggcgtgtggccctaaataataattctggggaaggagtgaccgtcagcattcaggtgccggcgcaagatattgaacgatgaaacaaaagcaaaattggcttgtgctcggcttggcgattctctttttcttcttagtaattggcatgctccaactttttgtacgctggcaagataatcattatagccagcaaacgcctcatcaaacgtcgtacagcttgcctaataagcaacagatgccgttaagcaatgctgaggccttaactgttgtgaccgaatatgccaatccgattaagtttaaaagtgatgttgacgaagcgggtggtgtggatttaaagcgaatcctggaaccagtaattggcgatattcctaatgatttgcagatacttgatgttgaaaaacgggtgtatcactcaaccaacggtgaggttgtgacaacctattatgttagtgcgatgagcaaaacaaatgaaatcgattttgagtttgtgcctagcaacaatttgattttgaatctgcaatggttcggcgacagtgttaacctgccgttgcaaacaattgtgcaaaattggcgcaacaacatcaacgtgacactacgtcatcaggaaagtttggctgatggtgaaattagtcaacaattcgtaggaggcattaattatcgatttgcgaaatcaaatgccagtttagtaatcacacttgtctagaggaaagtccgcaattttgcgggctttttttacgatacaagttagatacaacttctccgtatgcttaagcatatattagtttaagtagaggtttttagtgaacatgacagagcagaatagaagtgagcgattgcgtgttagtaagcgtcgcaacatccgttggggacgtgttattggtacagggatagtcgttgtgctgttagcgttggtcggtgttgtgggctttgcgtcgatgcgtgcaaagacggtggtcgacaagacttatcaagatgcaggtatgaaaaagtcgcgtgatgtatccgcaacgattcgagacggaaagccgttttcagtcttgttgatgggaactgatacgggtgaacttgggcgtaacgacaaaggtcgcacggattcgctgatgattatgacgatcaatccgcaacaagaggaaacgacgattatgtcgattccgcgtgatactttagttgctgtgcctggttatgaagatactttcccgcaaaagattaacgccgcttatgaattgggatcagccaagacagcgattaaaacggtgcaagattggttgaatattccaattgactattatgcactcgttaatatgggtggcttggagcaagttgttgatgaaattggtggtgtgaaagtgaagtcaccgctcacgtttgactataatccagatactgcacacgcaacacccgggaatttgtatagctttgtaaaggatagttcgacatttacgcatactggtgaggacggcaaaacaaagacgtataccaagatggatggtaaggccgcattagctttctcacgcatgcgttacgatgatccgcgcggtgattatggtcgtcaacaacgtcaacgtttagtgctggaaacagttgttgataaggccaaggctaatcccgcaaaattgttaacggatggattcatgacatcgctatctaaatccgtgaagaccgacttgacgtttggcgatatgacaacgattggcacgaagtatttaaatgccacaaagaatatcaagtcagattatattcaaggacaggggtacgacttggcgtcggggtctactgaagttgtgtcacgtcaagaagagcaacgtgcgacgaatgtgttgcgccggtcattgaacttggatgcagccgaaaccggtaacttgtatgctggtaagatttctgatgaagatgttgccgcaatcggtgtgccaacaatggcagcatctactggtacggcaacgcaagcgcaatagactagttgactaatctagtacactcaatgaagacacagcatcattgagagtgaaaggttggacgctatgacgcaattaacgtttgtatacggcacgatggcttcgggaaaatcgattgaaattctgaaggtggcccataattatgaggtgcagggacgtaagccgatgctcctgacttcagcattagatgaccgcacgaatgtcggtgaaatttcgtcgcgcatcggccttaagcaggacgcgggcattattcatgccacggacgaccttttcgaaatggttgcggggcaagctgaacaaccggcgattgtgttgattgatgaagcgcaatttatgacgcgtgaacaagtcatgcaattagcgcatattgtggatgatttggatatcccggtgatggcgtttggtttgaaaaatgatttctcaaatcacctgtttccaggatctgaggcgttgttgatttttgcggacaagttggaagaaatgaagacgcttgattcatttggcacgaaaaaggcgacgatgaatttacgcattcatgatggtaagccggtgtatgaaggtgaacagattgaaattggtggggatgaagcgtatctgccagtttctcgttatcattactatcacccggatgaagcagctattgcggcccgcttccgtaaacaaaattagtgaatcaagccactgacgtttttgcgacagtggctttttcatattcatgatatattggaagaaataggttttgggggataacgagatgacaacaacggcatatatgatgacggatactgagggtgttgtgcaaggcgattttgtcgagcgtgacttgcctgagttatcagctggtgaaattcaaattcaaacagctttttcaagtgtgaactacaaagattacttggcaagtttgcctaagggtggcgtgattcgccaatatccaatggtgccaggaattgatgtgagtggaacggtagtggcgtcgaagtcaggggcgtttacagttggtgacgaagtgttggtgactggctatgacctcggtgttcgtcatgacggtggttttgcgacgcaagtgcaagtgccaacggaatgggcggttaagctaccagccggtctttctttgcaagatgcgatggcaattggcacagctgggtttacggctgggttggccattatgaagttggaagggttggggatgcgcgttgctgatcaacccaagattgccgtgactggtgcagctggtggtgtaggtagcgttgcgttggcattgttgcaagctagtggctatcaaaatgtgacgccgattgtgcaccgcggtggagaaggtgaaacgacggccgatgatattctggcattgccgaataagccacttttgtcgcaaacttacgactatgttatcgacacggttggtggtgagctggcagctaagttgattgcgatgcttcactacaacggtgccatcgccatgacaggaaatgcgggtggtgttgatttaccaacgtcagtgttcccgctgattttacgtggtgttagcatcttgggtgttgattcagtggcagcagatatgccgacacgccaattgttgtggcaacgtttcgcggctgattggcatgtgatgaatgagctgccagttgaacaagtgccttttgaaaagttgccagatgtacttgatacgtttgcagcacatacgcataagggacgtacgattttgacattctaaccaaataagcggaacaagtttggataagacttgttccgcttattttttattggtttaccacccattcgccgccgttgggggtcatgttatatttcacaccgatattgtggatgtaaaaaaagtaatagtacccactagggttagcaaccaaggtattagcatttgtatcccagtggagatttgagagtgttccccggtaatcattgccttggtatttaacggaaatggttgcaccttgtgtagtggcaccatttgggccgatattagtcaaatcctgtgaataataaatttgatgcaacaatttcatggcatctgccactgccatattagtgccggtgactttaccgtttgtggcacttgtgacaggtagccagatgttaccgaaccaaatagaagtttgtgcgccattactggacaccagggtgttgtaactatttgaccaatagagttggccaacgttcgtatatggtggtgtcgtgaatggtgtgtaggtgtattttggcatgctgttaaaatacacggtataaaaatcagagcgaccctccgaagactgcaggggggtgaccgtcttgttcagttggtcggtttaagctgtcatcgttgccgttatatttcgaatacggttggcgtcgttcatatcgccgttgaaggtcagaattgtgtaagcactagcaaatacagtcgttgtcgcaatcagtgtgatgactgcagtcacgacaatcgttgatatccgctttttcataacgcttattgtttgacgttagaagtgtttgttgacggatctagtgaatttgcttgcgcagcttgcgatgtagcggattcagccgcggattgtgcggaactagcattgctaatggcgttttgaactgaagttgcatagttgtttgctgcagtaatttcgtcgttggctttctttacgtcagaagcgtgtgatgccttttctgaagttaagttttgagcagtaccagcaagattgtcagcagttgttttcaactgattagcaatcgtaccgatttgattgcctgcttgtttgtcaccatcgaatccgccaatttgataggctgcaaatccgacagtagaaactgcagttaaagctgcaagagtgataagtgtacgcttagcgaagcgtcgacatgaatttttcataatgtaacccctttcatgttttgaattataaagcggaatattcgagatacgaataactgctttttaacgactaattaaaacaagtaacgtttcatatgtatgatacaaaaagtctccgaatgagccttttagcatggttgaagtcctgatttacggagaaataaatcgacattttacttaccgaacattaatagtcaatatatatatttttttaaaacgtttaaccgtaaatatgaacaaaatgcatattgtcatgaagaaagttcggtgttattcttaactcaacctttaaggggacatacattaaggagtatagagggacatgtttaaaaagcttgttgcaggggctgcacttacgattgcagcttcaacgcttgttactgcattgccagccgcatcagttgatgccgcttcaaagaaagttagcttgaaggagttgaacgttcaattcgttccatcatcacaagctgacacgatccaagcgaaggctaagccattggaaaagttgctaaagaagcaattggggattccagtgcacgtaaccatctcaactgactacaacacggttgttgaggcgatgggttcaaagaaggtggatatgggattcttgccacctgacccatacgtacacgcacacgagcaatacggtgccaaggttatcttgcaatcagagcgttacggtattaacgacaagaagggcgacggttcaaacacggacaagcttgttgattactaccgcgcaattgtcttggtaaagaaggactcaaagatcaagtcagtgaaggacttgaagggtaagaagattgccgttcaagatacgacttcagacgcgggttacatgttcccagtcgttgacttgaagaagaagggtatgaacgttgtgaaggactctgacctagttacggttaagggccacgaccaaggtgttttgtcagtcttgaacggcgacacagacgcagcatttatctttgatgatgctcgtaacgttgttaagaaggacaacccagatatcttcaagcaaacgcgtgctttgatgtacacgtcaaagattcctaacgatacaattgctttgcgtaagggtatctcagctaaggattcaaaggctatccaaaacgccatgatcaaggtatcaaagacggctgagggtaagaaggttttgaacgatgtctacagctgggccggtgttgcgaagtcaaaggattcaaactttgacatcgtccgcgattaccaaaagcaaattgaagacatcaagtaagcttgatttctaaataaaacgagaagaacgggctttactggcagcgcccagtgaggtccgttcttcgtacatatcatgtaaaacggttcagcaaatttcgctggatttggttaacaaggttaaacaagagtggagagttattatgacagcccaaaaaggcacgattaaagttaacaacgtttcaaagatttatccgaacggcacggttggtttggataacattaacttggatatcgcttcaggtgagttcgttgtgattgttggtctttcaggagccggtaagagtacgttgttgcgtgccatcaaccgactacatgatgtgacgtcaggtgaaatcttgattgatggtgaagatatcacggttgcgaagggacgtaagcttcgcgaattgcgtcgtaacatcgccatgattttccaaaactttaacttggtaaaacgtgcatcggtggcacgtaacgtattggctggacgcgtgggttactactcaacgttcaagagcacgtttggacttttctctaaggaagataaggcgaaagcagccgaaaacttggataaggttaacatgctcgacaaatactacacgcgtgccgatgagttgtctggtggacaacaacaacgtgtcgccattgcgcgtgccatgatgcaatcaccaacggtcgtcttggccgatgaaccaatcgcctcacttgatccaaagacgaccaagatggttatggatgacttgaagcgtttgaacacggaaatgggcatgacggttgtggttaacttgcacagtgtgccacttgccatggaatacgcaacgcgcatcattgggttgcgtgctggtcaacttgtttatgacaagccaatcgcagaagttaacaaggatgactttgacggtatttacgctgaagcaacagatggagaatagacgatgaatgtaagtttacctgaacagcgtttcagcgaaaaatggcacgtcaagggtctactggcaacgcttctagttgtattaattttgtttggatcaggacgcatgacgggtgtctcaactgatttcagttgggaacagttcatggatatcttgattaagatgatgaatccagattggtcatacgtcacggcggtgattacgccaattttgcagacgattcaaatggctttggttggaactttgttgggaacgattattgcggtgccgtttagtttgttggcagcccgtaatttgatgaagaacacggttgtgcgtggtatcgtccgtttcttcttgaacttggtgcgtgccttgcctgacttgttgttggcagcgttgttcgttgcgattgttgggattggtccgatggctggtgtcggcgctttgacgattttcagttttggtatgatttccaagttgttctatgaagcaatcgaaacgattgatgaaggaccaattgaagcgttgacggccgcaggtgccaacagcttgcaaacgattgtgtttgcggttatcccacaagtcttcaaccaattcttgagttacttcctatacacattggaaatcaatgtccgtgcctcaacggtgcttggatatttgggagccggtggtgttggattgttcttgagtcagacactttcaatgttccgttacgatcgcacggccgtggttatcttggctatcttggttgtcgtggtgattgttgacggtatttcaaatcgattgcgggaggcgttggcataatgcaagtagttaagcaaagtccttggcaccgttatcgtccttggattattacagtgttggttgttacgttgtttgcctgggctttttctgggattccaatgtcatcagttaagccacaagcactattgattacgaaggctattttcacaggattgttccatccggattggtcttacgtttatacaggggatggcgaagatttgatcacagcgttggttgaaacgctggccatcgccttcttaggaacgttcatctcagctattttgtcagtgccattcgccttcttggcagcccgcacgaagaaggggttcttcacgccacggtcaacgttgggtaaggtgattttgacggttattcgtgttttccctgaaatcgtgatggccatcatgttcatcaaggcggttggccctggtgcctatgctggtgtgttggctgtctcaattcactcaattggtatgttgggtaagttgttctcagaagcggttgaaaacattgaccgcggaccaaatgaagccatcgtggcagctggtggatcagcgcttgatgggttgacgttggcaacgttgccagcagtcatgcctgaatttatgaattacacactataccgatttgaaatcgcggttcgttcagcggctatcttgggtatggttggtgccggtggtatcggtgcgccattgatttttgctttgcaaacacgtcaatggccaaaggttggtatcattttgctgggcatcatcatcatggtgacggtcattgacttcttgtcaggtcaattgcgtaagcgcctagtctaataggttagaaggtcatcgagtgctcggtggccttctctgtttaaaggagtacaacatgcaggtttctattatttcgacttctgatgtccacggttattttcgagctgatgatttccgtcgaccattacaaaacgatgggttgggtttgacccgcgcagcgacagttattgaaacgttgcgtgaacaagctgctccagaagatgtcatcattacaattgaaaacggtgattttattcaagggtcaccattaacgaattacattgaaaaagtcgatcaatcagcggtgagtttgtacgatgacttggctgaaacgattggttatgatgtgcgcattttgggtaatcacgaatttaattacggacgtgattatcttgaacgcgttttaggacaaaacgatttgttgctgaatgccaatgtgttggacgaaacaagtggtgagccgttcattggtcgtccatacacgattattgaacgtggtggggtgaaggtcggtgtcatcggattgattaccaagtacgtgccgaattgggaacaacccgctaacatccatgggttaacgtttgctgacccgttcgaagtcgcaacacgttatgttgacgaattgcgcccacaagtggatgtgctggtattggcttatcacggcgggtttgctgaagatttggagactggtgaaccgttggaacgtttgacgggtgaaaatcagggctaccaattgctacaaaccccaggtgttgatgcggttgtgactggtcaccaacatcgtaccctggcagcggttatcaatcatgttgcgacaacgcagcctggctatcgagctgatcaagttggtttgatgacgcttacgttaaatgacgaacgccaaattaccaaccgtgacgctcaattgattgccacagcggtgttccctgagaacgatgcagtgaaggcagttgttgagccagttcacgtggcaacgaaccactggcttgatacggcggtcggtcacgttggtcacaacatgcaagtgacgaatcacttcgaagcgcgtttgcacagccacccatttatcgctttggttaaccaagtgcaaatggatgcgacacaaacgacgattgctaatacagcgttgtttaacaacgaagtgaaggggttggctgatgaagtgacgttgcgtgacatcatgacgaattacatttatccaaatacgttagttgtcgaaaagttgacggggcaagatattaaagatgcgcttgaagtgaacgcacgctactttgtcttggatgataatggtcaaccaaccgttaacccagcgtttttggagcctaaggttgaacactataactatgatgtttggagtggtattgattacacctttgatttgcgccgtcgtgaaggtgaacgcgtgattgaagtgcttgttgatggtgagccgattgagttggccggtgaatacgaagttgcaatgaataactaccgtgcgggtggtgcaggtaactttgcatccttctcactggataaagtggttcgtgaagtgcaacgagaaacggccgatttgattggtgattacattatgagtcacccagatattaagattgaccaaccaacgaatttccatgtgatttattaaaaacaaagccggtttcgtctatgtgcagacgaaaccggctttttagctagtctttatcagaccaatatttcttttggtaggctttacgtggcatcatcatcatgtactcacgcaaagggttcttcttatagaattgttgatgctcttcttcggcatcgtaaaacggcttggcgtcttcaatgcttgtaacgattggtgcgtcgaaacgaccagaatcatttaaggcgcgctttgacgcctcggcaatttgtcgttgctcatcattcgctacgaaaatcactgggcgatagctgtcgccgcggtcagcaaattggcccatggcatccgttggatcggcgagctgccaatatagttcaaccaaatcgccatatgaaacaatgtcatcatcgaaccaaattttaacggcttctgtgtgaccagtttgatgtgatgcgacttgtgcataggttgggttggctacgaaaccgccagtgtaacctgaacgcactttttggatgccaggcatggtctcgaatggctcgaccatgcaccagaaacatccacctgcgaaaattgctgtttgaattgccatattattcccctccgtttggttcttattctactcagttggtacaaaaacaaaagcaatatttcaagactttcccttgaaaaatcgttattgcaacttttttggttataataatgactgacaaaagttaagtgaggacagagaaatgggtattacacttcaaattgatgacgcgatggttgcttcaatggcagaaacgattcgcaagagcattccacgtattgcgcgtgcgaatgagcaaatgattttgtcagcgccagagttatcagagcgcttgccaaagttgtcagctttgcctgatgatgaattggtacgtggttacttgcaattcctattcatgtcaatgaatgatacgaagatgttgctggaccgtgcttacgtcgatctatttttgacgtcacaattggcaacagttatttactgagaaactcttaaagccacgcgtctgcgtggcttttttgtaagtggtacgtgtaaaataaagtagactgaaaacgtcggaggttttagacctccgacgtgaccaagtcgcccttatcaggtgcgtctttggtcttacccctgactttagtcaggggttttagagcaacagctgctgtgataaaaaacataagattagtgaagagagattattatgattacgattaagtcacctcgtgaaattgagggaatgcgtaagtctggggcaatcattgccggtatgcaccaaggactacgcgatattattaagccaggtatttcaacctgggagattgaagaatttagtcgccaatacattgagagtcacggcggacgtgctgcgcaaatcggctttgaaggatatgaatacgccacgaccgtttcggtgaatgaagaggttgcgcacgcgtttccacgtaaggcgcttttccttaaggaaggggacatcgtcacagttgatacggtagttgaattggatggttattattcagattcagcttggacgtatgccgttggtgaagtctcacctgaagctcaacgcttgatggatgttgccaaagaagcaatgtacatcggaattgaacaagcgcaagttggtaaccgtttgggtgatattggagctgccatcaacgcctttgttgaagatgaaaacggctatggtaatgtccgtgattatgttggtcacggtattcaaccaacgatgcacgaagatccaaatgtgttccactatggtgttgcggggcgtggcctacgcttgaagcctggtatgacaattacgattgagccgatggttaacatgggaacgtgggaagttgaaacgtctgaagaagatggttggacagtgacgacgttggatggctcatggtcagctcaatatgaacacgtgattgcaattactgaagagggtccaaagattttgacaagtcaggatcctgaattcgatgcaaagtatctataatttgcaggaggtaaatccatgactggtcaagaatgggaagataaattccgcaaagaacgcgggcgcgttgcgcgccgtgaagaatatcgtgcagctgctgcacgtaattttgaacctgaagaggcaccggtagtagcgccagttgcgccagcgcccaaagtagttgcgaaaaaatctagtggtaagagcaagcgagcactgttcttattgttagctgtcgtagttgctattgtggctggtgcgatgacatataagttgacgcactctaagtctgacaatggcacagctaaggttgcatcgtcagccaagtcagtttcaaaggccacaacaaacaaggcttcaagtgctgtttcttcttcaagtagtagttcaagttcatcaagcgctagctcatcaagttcaaccaaggcgtcggacttttcaggtagcacacctggcgttgttgcaacggacttaagccgtactgaccgtgcaaagattattgcgcaggtggttatgtcgggatataacaagccggccactgatgtaaacggcattacagccggaacggttggcggtgttggctctggtaaaggaagtttgcaccttggtgttggtgtaaacggtattggtgtgcaatattcattgactggggatggcggtgtgagccaaattacaggtcgttatagcggcggtaatggcgacggcatgcacgacttctctatcgatgttaataattggttggcaaaccacgaccttgatgcggtgcgccaagcctttggcgacgtgacggttaccgatcaaaacgtgagcgcgatgggtgactaaaaaattagttaactttttagcttgcgtgattgtacaaaaccacgtatagtaatttaggtattaaaaagtaaataaattcgactttcctatcgagagttcagggagggactagaccctttgatctgacgccaacttacccgtttcgggcgatgtggtactttctagcagataggcgcatatcgactgaaccccgacatgccgcctatgagtggtatgtcggggttatttaatttcacaagagttttttattttaggagattagattatatgtcagaaaagcgtttgttcacgtcagaatcagtttcagaaggacacccagataaggtttcagaccaaatctcagatgccattttggatgccgttttggctgaagatccacaagcacgtacggccattgagacgtcagtaacgacaggttacgttaacgtcttcggtgagatgtcaacgacggcctacgttaacattaacgaaattgttcgtaacacattgaagcgcatcggttacgatgacaaggaagctggtttcttggctgacgatatccacgttggggtaactttggacgagcaatcacgtgacattgcgcaaggtgttgactcagctattgagcaccgtgaagacggtggtgttgatccattggaccaaatcggtgccggtgaccaaggtttgatgtttggtttcgctacgaacgaaacggacgaatacttgccattgtcagttgttttgtcacacaagttggttaagaagcaagctgacgtgcgccgttcaggtgagttgtcatacttgttgcctgacgctaaggcgcaagtaacggttgaattggacgaaaacgacaagccaatccgtatcgacgctgtcgttttgtcaacgcaacaccgtgagtcaatctcattggagcaattgcgtgccgatgttcgtaagtacatcatcgacccagttttgccagccgacatggttgacgacgagacgcgttactacatcaacccaacaggtcgcttcgtaatcggaggacctaagggtgatgccggtatgactggtcgtaagatcatcgttgatacgtacggtggatacgctcgtcacggtggtggtgccttctcaggtaaggatgcaaccaaggttgaccgttcagctgcctacgcaacacgtcacatcgccaagaacatcgttgcagctggtttggctgaaaaggttgaaatccaagttgcctacgctatcggtgtggcaaagcctgtttcagttaacgtgaacacgttcggtacgggtaaggtttctgatgatgaattggtagctgcaatccgtgacttgttcgagttgcgtccagccggaatcatcgaggacttggacttgcgcaagcctcgttatgaagcaactgccgcatacggtcacttcggtcgtcctgaattggacttgccatgggagcgtttggataaggttgatgctttgaaggcatactttaacaagtaatgaatattgatagaagaaaaggagcgccgaagttcattggtgctccttttttgcgtctaaatgggaaaataaggcgaggtattcggctgtataggggatacatgctacaattcgaccaaaggacgtttgaaagttgggtgtgcaatggcttataagtttgttgatgctggattggagttttcacttgtactcagtgtcaaagggggatgaagaatggtatggcacaacgctgtcgttagaaagtgagtggataaattacacatcgttgaaatctaatttacttgaaaggcgagaagtttccggactatataattttgtaaagagatgggcagaaggcgattttactgacgtcgaaattagctttatggaattcgaattggttctgaagtatgaacctgagtataaagaaataatgatggctgtggagattgattcttatgacaaaggtaaaacgggtcagtattatagttttccgatcgaaaaagaggatgtttcaaggctatataactatttggaagaagctgtaccaaatcgactgaagagggagtggaagtaatgcccaatcaatatgttttcttgttcccgtcggacttcttaaacaaccgggaacctgattttgattataaaaatgaatacgaagctgccaaacgatattttacggttgtcttgataaatcaagagaagcttttcgacagaaacgaagtaagcgtgaatttgaaaatatcaaatggcgatgttgttatatatcgtgggtggatgttgaagcccacacaatatgcattgctggttgcctatgtgacgcatcatggtggccgtatgtttacagatcaatcagcctatgaatacacgcaccttctgcctaattggatgcaaggggatggtagttatgttccggctgtatggactgaggatttatcagatgctgccatcagaaaaatgctgtctcgtttttctggtgcggtcacgattaaagattacgtgaagagcaggaagtttgagtggtcggacgctttttatattccagatgtagcggatgagcaaaatgcgttacgagttattcataatttcatttcacgacagggtgatgatttagtaggcggattggtaattcgggaattcgttgatttgaaatcaattggtgagcacccacacagccacacgccgatttttgaggaatatcgggtcttttatatgcagcgtaaaccgctggtgattattgattattggcgtaatgacgttgttgaattatcagaaacagatttacacattattaatcgagtaactgaacaggttgcgtctgatttttatacggtagattttgtaagatcaatcgatggcaagttaattgtcatggagatgggagacgggcaagtctcggggctacaaaattatgatgaacaacgtttttatgatgcgataaaagaacgactattggattaacttatggtggagaagactatgcaatttgaaatgaatttaccgattggaaatattggtatcgcttcgtctcaaggaccagttgcatttgaggtgcttgatggtttagctgagtttcagaaatatcaggcgcgctggtgtaagtcgaagtggacagtagattggcgatatattttgaaccccatatttgatatagaactcgattacaaagatgtccaactggttgcgaattttgatttaggtacatttattgatgatgagtctagtgaaggatatagcggtggaagttggaggataggtgatactcaatttggtgccgctggatgtgatttggaactagatacggaatttgctaatctttggttggacgagacacatttgccaatatattctgaattgtcagaaggcccacttgagtcttacaaattttcagttgcaggtaaaaaatatgtttcggacgaagatctttctgtgtcgtttgcgctggattttttacagggtgagtaattggagtggttttaacgagcgataaagattattttaatcattgttggtgtatgtgcttggaatgattttgctattttttaatgactgtgtatgggataatgaagttaaatggaggaggggtaaatacatgttcaagattgctaattacacggacaattgctcttatgctagatttacggacagatttttctctgccctgtaaactaatagtagaggagcattttttatatgattcgatattcaccagaatttaagcaatctcttgtcgagatgcacaaccaagggcgttctttgggttttgaaaatttttcggtgtagcggcaccttgcggtgtcgaaaaaacctgtccataatcttgacagcagcgccggtgtcgagacagataatgtttttgtgaccggaaatactgtgattgatgccttgcattacacgttacataaagattataaaaatcccgttttggaccaaattcatcccgaacaaaaaatggtactattaacgatgcaccgacgagaaaatcaaggggcgccaatggctcgtgtctttagagcaattcgggatatcgtgtttgaaaaccccgaagttgaagttgtgtatccagtccacttgagtccagctgtgcaatcagtcgcgactgaaattttgggtgatattgaccgtgtacatctaattgaaccactagatgttgtcgattttcataatttagctgctcgcagttatctcattttaacggattcaggtggtattcaagaagaggcgccttcattaaatgtaccggtacttgtgttgcgagatacgactgaacgaccagagggagttgatgccggtacgttacgattagttggtacggactaccagacagttaaagctgctgttgaaggactcctgcatgatgagacgcagtatcgtgacatggcagataatacgaatccttatggtgatggccatacagctgaacgaattgtgcatcttattaagcagtttatgatgtaagtgtgttcaattattaaacacgtaataaaacataccgaatccaggtgtttatatcagtttttcatttaggagttagttataataaccacaaggaactaactaaagggagtatgaaattatgacagaagcaaatttggatacgaaagcattgttggagaaatacttgcgtgattcacacgttttgaacttggcaacagccgttaacaaccgtccatcaaaccgtgacgtcttttatttgacgcccgatgagttgacggactacatttacatcacaacgagacgcaactcaaacaagatggccgaaattgaggctaatccatttgttgcgttcacgacggtgccaactgatgaggacaatggggtagtcacatcaaacaaggctgaaattcatttgacggacaagtcaattgatgacgtcgccgaattgattgaaaaccaaattccaaactggatggatgttgctggcgaggcaaaggacagtttcgttgtcttgaagttgtcattcagctcagttaagattttcggtgatcaaggcatcagctctttgttgttgaacgaagaaggtgccacacaagaaacgttgtaagtattgatatgaaaggttgtccaatcgggcaaccttttttctttctccgggatgtttcggaaattaggcatatgtattcggtacagtaaaagtattaagacatagggagagagtgttatgccttttacgaaacgaattattgctgggtcgacgttaatcacgctgttgccaatcttattcggtgccatgctgtaccatcggctgcctgatcgcatgtcaacacattttgcggcggacggatcggtcacagagaccatgcccaagttagtagtggtgttcggcttgccgttggtttttgccatcattaatgtgattgttttggcatttgcgaatgctgacccaaagaataaacacttaactggttttccggttgcgattatcgcaagtctgattccgtttattacggccggaacgatgttgatggttgatgttttagcgctcggctaccgggtccaaatcacaacggtggtgatgttcatcttagggattgtgtttatcgcaattggcttggtattaccgaaagtggatacgagttacacgattggtattcgcacgccttggacgctatcaaaccgcaataattggcgcatggtgcatcgtttaggtggtcgcttgttcattggtgccggaatcttgctattcggctgtgcgggctttaatcacacgccgattttcttaacgattctggctatcattattttgatcgttgtcatcgtcccaattgtctattcatatctgctttggcgccaatctaatcgttaatttgagggattaaatgcctattcgacaaatcggacacttggcgttatactaaccttacattagaaaataatgagggaggaacgctaattatggcagttcaagatattacggatgcaacattcgaacaagagacaaatacaggggtaacgttgacggatttctgggcaacgtggtgtggtccttgccgcatgcaatcacctgttgttgaaacggtggctgaatcaatgcctgaagtaaagttcaacaagatggatgttgatcaaaaccctgccacggcgcaagaatttggtatcatggcgattccaacgctccttgtaaagaaggacggcgaagtggttgaacgtttgactggtttcacaccagcccaccaactagaagcaattttggcaaagtacgcctaacgattaaaagagatgttcagacatctctttttttctgcggtaaaatggacatatattttaacgattggacaataatgatgaaaccactgaacgaaactgaaattgcacgtttggcagcgctagatatctttaccaaaattgatcaaggcgactggtaccaatatggcaaggaaaccccaattacaagctattacgcaacgtgctttccaacaggtgcaacgaatgaatgacgttgcaaagacagatatgtctgaagcaacgcgcttgttgcatgagtttttgcctggcatggcgacttcagcctcaatcacattcccagtgaacacgattgagtatccggaacagttgattcttggcgaggacagtttcatcaacgccaatctgcaaattgtcagcgctggtaaagtaacaattggtaaacatgcctttatcggtccgaatgcacagttcttcacgccaaatcatcatccatataacgtagcattgcgtcgtgaggggtggcagtatgattcgccaattacgattggggatgatgtttggtttggtggttcggtgattgtcctacctggtgtgacgattggcgataacgtcgtcgtcggggctggcagtgttgtcacgaaggatgtgccaagtaacacgatggtggctggtaatcctgcccgcgtcataaaagatttaacacaagactaaacgaaaaccggcggtatctcgcgattgagatgccgccggttttgttgttaatttgtctttgcccaaacgaatcccttgctggtgatgttcgttggttgtgggatttgaatatccggatgctccgcgatgtagtcaccgataaggtcggccgtctcgatttggacttcacgaacaaccttgtcgatactgtacatcttgtagtttcccgtgccagttgcacggtagttgttcatcgtgacttcaaacgactccgtcatggacatcggttggttgttcaccttcagcgacgtcacgcgattaccggcaggacggctgaaatcaaaggtgtaatcgatgccactccaaatatcatagttgtaatgttgtacttttggctcaagaaaacgtggattcacaatcaattcgccatctgccgtaacatcaaagtagcgaccgctaatttcgagggcatccttgatatcttggccggtcaacttttcaacgactagcgtatttggatagatgtaatttgtcatgacatcgcgacgagtgacttcattaggcaacccgcgaacttcgtcattaaacaaagcggtatttgaaatgtgggtgcaggtcgcagccatttgcacttgattcactaattcaatgaacgggtggttatgcaagcgtgcttcaaagtgcttcgtgacctgcatgttgtcaccaactgtaccaattgctgcatccaaccaatcgttaacttggtcgttcaaggttgagaccaactcaagaatggccgattcctccttgaagttccccgtggcaattagctgggcattggcgtggttaatgtgcaattgctcatccaagtctagttgaatggcaccgacgtattccgcccggtaaccaggctgcgtggtaggtataccatcgacaacttcagcaatcgcacggtgttggtgcccggtaatcagcgcatcgacacctggcaatttcaaaagctcataaccttggttttcagtcgtcaaatgctccaacgcttcgccagtctgcaaatcacgtgaaaaaccaccgtgataggcaatgactaacacatcaacatttggtcgtaactcagcaatataacgctcggcagttgcgactggatctttgaaaaccagaccgcgaatgttatctgggtgctcccaatgtggaatataagacgttgttagaccaatcacaccgacacggatgtggttgcgattgatgatggtgtagggcttgccgataaacggttgaccagttgttgcatccaaaatattggcgttcaacaaattatctacgccggtcatcgcactttctaagtactcacgaccatagttaaattcgtgattccctagaatccgaacatcaaatccagcagtgtctgccaagtttttgtaaattggcaaatcagcgcggtccattttttcaatatagttggtcaacggtgatccttggataaaatcgccgttatcgatggcaattaccacgtcatcaggcgcggcgtgtgtccgcaactcgttcatgacagtgacggcacgggacaagcctaagcgggtattcaaaagtggtcggcgaaagtcatcagcacggaagtagccgtgaacatctgatgttgaaaccaacgtgacatgcatgataatgcctccattaaaatttgtgttacttaataaacagaataccgcaaaagtaactaatttaaaatacattagagcacctaacgctaaggtgttatttaccggacgaaatactttgaccaagtttgacctgttagtggtcttaatggattgacttactttaaatggacgctttttaatgcgtctatgcacataatgtccgttacgtaacgaacgaaaaataagaaaactctttcgattgataattatcatgctatactaacggaaagttaggttaataactgcaaagttatgactaagattatgttgaagtatgggggaacaatcgtggaagtacggtttgagcatgtcacgttaacgtacagtaatggggttgaggtgctacatgatatggattttgaactgccggatggtgaattaattgccttgttaggaccaagtggtggcggaaaatcaacgaccttgaacctgatttcaggtttgctacaagcgacgaccggtcagatttattttggggatactgacgtcacaaagaaagatgcgttgcagcgtggtgtggggatggtattccagaattatgcgctttacccacacatgacggtgttggataacattattttcccaatgaagatggctaaggttgataagacgacgcgtgaagccaaagcaaaggaactggccaaattggtccgtgtcgatgatcaactgaacaaaaagccgggtgccttatcaggtggtcaacaacaacgtgtcgcgattgctcgtgcattggcaaaagagccaacagtcttgttgctggatgagccactttcgaatttggatgcgcgtctacgtgtcgaaatgcgtgaagaaatccgccgtattcaacaagaaaccggtatcaccacagtatttgtgacgcacgaccagagtgaagccatgcacgtggccgacaaaattatggtgttgaatgatggggtgattcaacaattcgattcaccacaaacgttgtaccaagacccagctaaccagtttgtggctcgctttattggtgatccggtgattaatgaagtaccagctgatgcgctacgtcaaaccttgagtttgccagccaacgccgccaccgtcggtattcgccctgaggccattcaaggtcttgtgcctggacacccaacgttggccgttgaagcccaacaagtgcgtgcattcggtcgtgaccgtcaagctaccttgaaactcggtgagcacaggttggtctcaaccgaattgacgattgccactaaccaagtatcgcttaatccgctgggagtattcgcctttgatgcgcaaggtgttcgcttgccgctagggggtgaataggcatgatgaatcaaatcaagccaacctggcgtgacaacttaaaggcgctggcctatttggcacctatgctggtgattattgcagtgttcagcctgtatccgattattaaaagtttggcgatgagtttttacaccgattacaactttttcacgaatcaggtcaatgcaatgggcttcgataactttaagaccctatggcaagacaacgatttccatctggcagtttggaatacgattattttcgttattggcgttgtaccagctgaaattattatttcgctggttattgcagtgttgttgaatcaaatcaagcgtttcgctggtttcttccgcacgctttacttcatgccgttcgtaaccagtgttgtggctatctcaatggtctggcggtggatttacaacaaagatgccggtctattgaactacttactcggtttcgtcggtgtacatccgattgattggttgaacgatccacactatgccatgccggcgttaatcattttggcaatctggaagggattgggatttaacatcttgctcttcttggtggcactgaataacgtggacaagcgcttatacgatgccgcgatgcttgatggtgcaaacagctggcaacgtttctggcatgtgaccttgccgatgatttcaccaatgacattcttggtgacggtgaatgcggtgattggctcgttcaaggtgtttgatgagattttcgcgctgttcggcggtcaaccaggacctggtcacagtacgttgacggtcgtttactacttgtatcaaatgttctatgagcaaaacaagtacggcctcgctgcagcatctggtgttgtcttgttcgtgatgattttggtcgtcaccctgttccaactctggtggagcaagaagcacgtgcactactaggagggcgtcatgaaagcaaagaaaacaattgtttatatcattttgacgctcggcgcgattacgatgttgctgccattcttctggatggtgtcgacggcattcaaaaccggtttcgaagccttgcaaacgccaccaacctggttgccgaagcacatgcaatggtccaactgggtacgcgcctggcacgcagcaccgtttgcaacatacctcgtgaactcagttgtggtgtcactgacgaccaccgttggccagttagtgacgtctattctggcagcttttgcgtttgccaagttgaatttctcagggaagaaagtcttattcacgattctcttggcaacgatgatggtaccgggtgaaatgctaatcatcccaaacttcgtgacgttgtcagaaatgcatttggtcaacacgtatggggcattgattgtaccttggttggcgtcatttttctcggtgttcacgctccgtcaaagtttcgccagtgtgccagatcagttgtattacgctgcccgcttggacggtgccagcgattggcaattcctctggcgcgtgttggtgccaaatgccaaatcaacgattacggcgattgggttattacaaatcattggtagctggaattcattcatgtggccattgattgtcacgaatacggaggggatgcgcacgctaccagttgggttgcaagccttctcaagtgattctggcgtgcaatatccagaattaatggcggcgtcaacgttcgtcatcttgccgatggtcatcatgtatttgttattgaacaagtacgtggttgccggcatttcaaatacaggtattaaaggttaattaaccgactgttcacagcatgtttgtggacggtttagtgatgagaagcaattgtcaccgctaaactgttcagaaatatcacaagggccctgtggtatgcctgacagtcattaattgttagttatgtgggaaaaaaggggaacttttaacatgaagacttggacaaaattgttcgcaggttcagctgtattggcattgacatcaggcgcattcgcaacggcggttccaacggttgccagtgctgcatcaaagccaacgaagattacattctggcacgctatgacgggaaactacgccaaagcattggacgaacaaatcaaggcatttaacgcgtcacaatcaaagtatgagattgtcgcaactgcccaaggtgactacacaacgttgaaccaaaaggtcatagcagccgccaagtcaaagacgttgcctgacatggcacaagcaacgtacacacaagtaccagactatgccaagaatggtatcgtcgccaacatggatagccaagttaagggcaaggatggtctctcaaaggctgatttgaagaacatttacccaggattcttggaacaagccaagtacaagggctcatactacgccatgccattctcagcatcagtgcgtgtgatgttctacaacaagtcaatcttggatcaatacggtttgtcagtgccaaagacgtgggatgatgtggccaagatggcgaaggtcttgaagcaacacaacatcgccgccgtgggatatgacaagtcatttgatatggaatggaactcaatggtgcgtgccgctggggttaagttggtcacaccttctggtaaggtcaacatcaactcaaagaaggctgtggcagcagctaagacgattacggacatggtcaacaatggggaagcgttgaccgctggttctgacatttacggtacgacaaacttcgtcaacggtaagacagccttgtcattctcatcgtcagctggtatttcagcaaccaaggctgccgcaccagacggcttcgactggggtacggcggtaatgccatcatacgaaggtaagaacgcgacgatgctagctggaaacaacttggtcacgactgcccaagcgtcaaagaaggaacaagccggtgcgtttgcctttatgaagttcttggcatctgataagcaaactgaaaagtgggctgaagctactggttacttgccaattacgaagaaggccgccaagtcagcgtcatacaaggcttacttgaaggccaacccattggcgaaggctgcttcagattcattgccaggtgcgttctctgatacggccttcttgggttaccaagagtaccgcacggacttgttgagcgcgactgacgcaatgttgacgaagaagacggcacctaaggatgcgttggatacgttgcaaaagcaaacgcaaaagattgtgaaggaaagcaagtaacatgacgaccacggtaacagtactaaacggtgttgataccatcggtgggaacgtggtgtcatttgaaacagaacaagcgcgtgtcatcatggattttggcatgaactttgcgccgactgatacgcgaccagatgatttgttggcaagtggcgtgctacccaatttgccagacttgttttcggacgaaaaagcggctgagcaggaaacggcgattttcgtgtcacaccttcatctggatcacatgggggcgttgcaatatttgacgaagccaacgccggtgtacatgagtccagagtcagccaagttgtatgccgagttgattcgccaaggtgttgaatcagcaccgaatgcgcaaatcaaggtgattgctactgaaacaccggtcgaaattggtgatttgacggtgcgagcattcttgtcggatcacgatgcgatgggagcttatatgtttgaagtcactgacggcaagcaccgcttcgtgcacagtggggatgttcgctatgatggctggcacccagaacgtgtgacggcctggacaacgtacttgcatgaccatcaaccagacatgttctttattgagggaaccgagttctcattcgacgctgacccaacccgtcaacgtcgcacggaagcaaatgtgctagctgatttgtcagcggctatgacgcaaaaagaactggtggtcataaatccatatgagcgcaatgttgagcgattgatgcgcctgcaagccatcgtgcatgattttggtcgtgaattggtttgggatgcacgctttgcggggattctaaaagcgatggggcacaaggatgtcgtgacgttcggtgaagacgtgacgttaaacggtattatggctaaccagcagcattacgtattacaaaatcgcttcgatgacatcgcggtactcgaccatttcgatcgcttcaactatttgcacatgaatggtgagccattgggtgattatgatccacgttatgctgagctggtagcttatctcgacaagcgtggggttgcattgcaaattgccggcgcaagtggtcacgccacaccggatgacttgctacgcattgcagcggaagtgaacgcgaaggttacgctaccttggcattcatttaagcctgaacgagaagcccaggcattgcgtaatatgggactagaaacgtatctgcctaaaaagggtgagacgtttaaattcgactaattaagaaaagacctaattccaattgtaaggagttaggtcttttcgagttatttagcatctagctttcgtttttgttgaataaccttcaagataagaatcacattcaacaaaagagacaaaattagtaaccatgggaaaaatcgatagtaccaaggatttgaaatggtcgtccatcgatcgtttttttcgtcacttgtcagcacatcctcagagtcgtcggaaacgctaatatcactatcgttcacaggtgtatatgttaggccgttagttaatggttcctctgaagtgaggaagttcgtgattgtgttaattgttgttgcactactaatcgttgagtcaatcaaccttttattagttagaagtcttaggctactttcatcggatgattcgaccgcatctgcaccatctttcccagaaaggcttccacttgtttcgttatcctcggcatcgtttgagggtccgataggaagcgtgtcgtcgtcagcaggtgggccaattggctgaacgtcccctttagaaggaggcgcgataggttgcgtgtctgcagtagaaggcggcgcaataggctgcgtatctccggtagagggtggtgcgataggttgtaaatcaggatcggattcatctctatctggtggtgtaataggttgcgtatcaggtgttgatggcggcgcaataggctgcgtatctggacccggctctataacgccagtaacaattaatccataacaaagggttcgtcgcaaattaacgagtgatgtgtattcaaaagtactagttccgctgatggttcgaaaagttgaaacttcatttgggtgtgcgccaggtgttcgtagcatcacttctttgataccttcagccgttagtctcgcaccatattctttggcgcgtgcactcacagcgccaccggaactacctacttctgctaaatctgatccactaagtaaaaaggcttgcttcgtaccaattgccactgttggtgtggttggtatgacgtttgatgccatagagttataaaatagctgaacgtttttattggtaggatcactgccaccaaacgtatttgattcccaaatgccatatttcccctttttatcgcttaaccttaagttcggaacggaagtaggcgcgatgtaatcttcgtattttgtgccagcgatagcaccaaagccaccagtcgtgccgtgataccaggaatcaagctgcatgtatggcaagctttcttcgtagccatacaagtcattgtcgtcccgagcgaaatagtatgagctgacgccagtaaatgcttgtgaccaagaaaggccaccagaaagatgggcaattaggtatgtgtcttgcttcattgtgccttcgcccggcgctctaataatcgaccaaaggctgtccatgaacgtattggtaccatccccattgttcacaggggcgtatgccactgctttagaagaatcagtggcagtggcatatgtcagaacaggttcggtaaacgtagttgcaagcagggatgcaaccattattgaaacttttgctagtttaaaaataatcatttcctacctttcgaataattaagtaagttaattttgacaggtcgggcgaataacgtcacaccgtgatttcacggcattggacaaatatgtgaaaatgattagtaagcgattgtgaccattgattattacaattgtttgaactttgtcacgatgaactttaggaatcttatatagtaaatagttgtaggcggtagacagaattttctctctcgcaactacacagtcccaccgcctacatgaaagacacaaaaatgcgccctgaatttcagaggcgcatttttgtgttgtattaggttgttacgggaattgccaaaatatcttctaatgctgaccaatcggcggcggttggtggcatgtgccattgcagttggaatggcacatcaagatcttgaacgttaatatccgaaacaaatagcaaagtgttttcagtaatgtgacgttcaacgacgatgttggcgtttggtcgatctttgaagagcgattttacaagcaaatcaaagttcgcgccctggctaaattcaaagacgacatggaagggcggattgaccaactcgagtggaattgtcgtcatcatcaaaaacaggtaatcatacattatgccagcttggtttgaggttactctctttcgattgtggctgaaagacggcgtaataatgttggtcatttgcgatgcaaattgcatgtagtcgttatattggtgcaatgcgattgtgtctgatggatcaaaaatatagtcggcatttgtgtattcaaaaaaatacagtcgtgaatggagtcgacttagtgaatcgcaaacggtttttgagaaaatcgtctcagatttagtagcatcaagcttgaaatagcgaccgaattcattaatgaataagttgtttaggttactgataacagtgttttcaagcacaatcgcatcccactcaggcgaatcgggtaacatggcctcgctatacagataacgcaacatcatgtagctttctaatttagcatcttcttccggtaaatttggaaatttggctaagatggcgtttgaaagaccatcgatagtgtgctctggccagcgcatcaatatttttttgaaacgtggatcggtttgcaattgctggcttggattttttccttgagccatacgcgtgaagacaatgtagtagacgtattttactttgattttctgaacttgcgtaaatttaaattttggaccaccgattatgttttctatccgtgcaataccttcttcaatggcagcatttgtctcacaatcgaagggaagattttcaccaaaaatttgaaatacatttcaaacaaaaacgaacggattgaaacttcttgtccttcgaaacgtagattagttgagatggtgatttgatacttttcaaggatgttctcaagtttttttctaacgcgatagacactggttggtgagatgaagtattcgtcagcaaagtcatcgatattatcatgggtcattaagaaacaagcctcgagcaacttgtattcgatggaatttctgacatagtggcgtagccaaataatgatgtttttgtggggcggtgaaacaagcgttacgagattgttttcaaagtggagggagaaagatgattccaaattgaaggccaagatatcgctttgcagatcggtaattatttttttgctggtgtgattcgaaaagtccaacgaggtagctaatttgctaagtgatgtgtttgggtgattttgtaaatattgtagggccttaacttttttccattcagtttcattcaataatttgaacaaactttcatcctgactcataactgctctccttaaaacgttttacgtacaacctagacaatacttcaaaaaacagactgactttcacccgttctgtgaattacttgtgaacttacctatgaccaattctggaattgtcgctctaatagtggtcctgggagtcaggaataatcaactaaactaaaggagtaacgcttttggttaaaaagaggtaaaacttatgaattgggcaaaagaactcattgaattatcggaacaacatggtggtgatatgttgcaccctgaggttgttaagtacggacattatctgtggcaaaaagcagatgagtcccgttttttggtagatcgtaatcgaaagtttaatgatataaccaagctctgcagtttcctgcatatctcgaacaatgagtttataacacgcgcaaacaacggcgatgaacttaatctatcgaaattgaaaatcaatggtcacatcgtggaaatcaacaaaaagtcgggcagaagtggattcggatcatagttaagtacggtagataaattcatacagcatgaccagaacttttcttttaaccggattatcggacacatgcaaaacgtaaaacacgtcatgatatttgttgctcaacaaaacggggcaaaaacaaatttaaggggttttttatgtggagtcgtaagattaagcgatttacgctgctttcaacagcagctttgatgacggttggagcaagtccagcggttgttgataatttattcaccgtgacggcggctgaaaatgggttgtcatttgaggatgctaaaaacattatcgtgggaatgaatgacacgtacatgtggtcaaatgatgagggtaagagttggacccgaggaactgatcatgatgtattcaaaggcactcaaaaggttgttgttgccaagtacgatgccgatgtagcatctgctgaagcttggaacgctacgtcttcatatgcaactggtgcagttgttgtgtttgaaggtaaggtgtatcgtgcaaaatggtacgctgagccgggtgttaagcccactgctggagaaccttggacgtttgtaaagaacgtaccgtcatcagttgcgacgtttgaatttcatcatttcaccggtgcggatgctgacaattaccaaaagtcagaagccaacacagttgcaaagcaaaagaaagtcattggatacttcgctaactggcaagggtataagacggattatgaaccaagtaatccagactatagcccatatacaggcgtcttagatggtaagggatatgacccacttgatgtgccgttcgataagattacgcacgtgaattatggatttatgattattgatccaaagaccaagcatttggtttctaaggatgcttgggctgattttgacacgtcagttgaaagtggtggaaagaattacattggtcaaattaatcaactggccgaccaacatggtgttgcgtcaatggtttctatcggtggttggtcaaattcagttgatgacttggcgttcgataaggtaacggcaacgcctgaggacatggataagttcacgaccgaggctgttgagttcatgcaaaagtatggttttgatggtattgatattgactgggaataccctgacaacgatgatcgtaagacgaagtttgttgctttgattaagcaattgcgtgaaaagtttacggctgcgggtagggaagatgatatctattatcaactttctatcgcagtaactgcagatcataagaagatgcaatacatcgatccaaaggttgttaaggattatgtggataacgttaatgttatgacttccacggtggctttgattcacaaacaggtcataactcaggattgtacgctaacgatgcggacacggatcaaaagtttaatttgtcatcagctatggctgaatatgctgaaaagtatgaagtgccaaagaacaagttgatgacaggattgtcatattactctcgtggattctcaaatgttaatgagggtaagattggtgcagcaagtaatgggacgcctgttggtggttcatgggatgatccttacgcaccatcaggaaacaagccttggtggcaaattaagagtcttgaagcagatgctaagaagagtgattcagattctttggaataccactgggatgatcaagctaaggcgccatatatttatgatgcagcaacgaaggaattctggacttacgataataaggagtcaatctcaaataaggttaactggaccatgaataatggttatggtggtgcgattatttgggaaatgtcagaagacacacctgacacagctgaacttggtacattggctgcgaagattgcggatggtaacaatcaagaagttgcattgacagctgaactgaaggaccgtgagccaacactcttccttaacatgtcaaaggaatcattcaacagcaaggataagtactttatctacgtggatggtaagtatgttggaaatacgcagtctggtgtccattactacttctacaagaaggtttcaggtgataaggtaacagtttaccgttcatttgcaggaaaggctgggcaaaagattgaacttcgtcgtgcacctggtggggatgacagcaagatggaagtcttgaattcatttacattagatcgtgatatgaagccggttgaagtaccagaaatcgctgatgccgtgaagaagattacagcttcatcaaagtctactgacatcagcgtcgcctttgatcgtggtgtattccaatcaaagaatcgttacattgttcgtttgaacggcaagtacatcttcgaagcgtttaacggaactggttattatacaaattcaactaatacggttgataatacatcaacgttaacgcgtcgcaacatgacagttaagccaggtgacacggtgtcggtttcgttgactgccggttctcctggatggccaacgggtacagtatttaacgaaactgaacttgttgtggccgaaacggttgtaaagtaacacttcaaatcacacgataattaataatttctgaatagaaagtggtggcgctacgactagtgtcaccgctttttatgttaatacaccattattttggaaggtaaccccaaaaaagcggtgtgttgtcaaaaaactaaagtgatacattttaaacatattgagtctgttgtttttgggttaggagaatgattatggtcaaacgttcatgtttcaatacgctttggacgtttttaatatttgccgggctgagttgctcatctcgctatatttatgggatggattttaatttcatcctgccaatattattattcccgttcgtactaatcgtcatcattatctgggtgattacagttgctgactggttagttgagttctgaagggggagaaaatggcgttaaaaagagcaattaaatccttttggatgcattactacaatctcggtggccgtacgtcgagatcggattattggtgggctatgttgggtcacgtcatcatatttgtcgtttggctggcggtgtttttgtcagttttaggaacaaacgattcgttagaaagtctccgaattactagcgtgagtacaatgtggttagcaattaataattggacgcaaacgtcgagtgacatgatgttagtggttgatattgggctagttgtagtggcctttctgttgttgcccactattgcgattcatatccgacgtttgcgggatgttggcatacatcctttgcttgcctggaatatttggattttgtcggtaatctgggtaatgcctttaaactcggctgtcattacaggcattagtttaagcgctttgcttctttcaatcggcctgacatcgctgccgacttcgagcgtgacgcgcttactacgcatgaatgaagattagtgacgtgattttttgaattttacgacgaaatgctgatttttcgtcactgcattgttgaaaaacatgacaccattatttctagagaaatctgttcgtagtacagatactgaggagggaatatggtgaaaatatttaatcacaagtgggttcgatgggcttggtacaatgtcacaatcattctttttatcgtttatctatgtaatatatacccacctttctttaattcatgggcctttgagctgtttttgacgttcatgtttatcagtggggtgtgcatatcaacaatcacgcatatgaagcgaatccacaaagattggcattaatcacgaaacgtgactgacgacgaatgatggttttaaatggatttaggtcacaggacaatcagaatgacggatatactaaacgtagttactcggataatcatctttctgccaagaaacgagtaacgacatttcttaggtttaatatgatcactgtctctgatctaaagctaagcttctctacggaaccggcaatcaaaatgactttccagtcgatttgattgccggtttttgattagtttttcaacattcgcgtagattgcttaaaaaactgaagtgactggtaatcagtgcgtgcctacaatataaaatcgtgaccagagataatagcgacttttaatttttggtcaccgagatattaacgttaactatatagttaacctgtttaactagttgagcttatctagttattatcagaggagagtttaaatgtatcagtatcttttaccaccggtcaaaattaagcggctggagttgctacatcatttggtatctggaaaaaatttaaatgttaagtcattggcgcgcgaccttgacttaacaccttctggggtacgacgtttagtggatgtgcttaatcaagaggcgtacgtcctattttcggagccgaatttttttatttttgatgatattggttttataaaaattaatgatgttgacactaaacttgataaacataaatgctttcagacgataaaattgacgtatttacaacaatcgccaattttcaggttattacatgaatttggtattaacccagttcataaggtgattaacttagaagatcgtctggcatattcgacgtcatacatttacagattaatccaccgaacaaataagtttctgacccagtttggttttgaaattcaggaagtggatgctagaaaatatgcaataaccggtgatttgttgtgtgttaggttcttttactatgtgttatttgcagatagctttcaaacattgaattggccttttgaagacgtgactaaaggggcgaatcttgaaaccatggaaatgggtagtgagtataagacggcttccagtcagttgattctaatgacgtattggtcgacacttcataaatctcatcgagcaagtaaatttttatcttactcagtaacgagcgacataaatcaagtcttgtccatgtttgagcgagatagagggttttatgatcaaaacgtcgaagatgggtatctgtttcatttttttaaacatctggttgtttcgacgtcgtttgattttgaccgtaaagtcgcgttgggtaaatcattcgcagaaagtgacaacttcatttgccaaacagcacaaaagttaacccagcaacttatcggtgatgcagacgagaatgctgcgtattatgcaaactatgtttttgttttaattattttgttgtccaaattgagtggtggcaaaatgctaaaaattttggaaatcgggtttccgttccccgaattctatcaggtgcaagaaaatgatttaacgactcatgtggaaatggttgtcaatacaacgctccacaaaatgaatgatgtgtcgttaatccctgcaactgaggttttaataaatgcaggattaacgattctgttgatgaacaccaatccgcaactaaatgtttttttgcagttatcaagaacatttacggcgcaccgattggttgaaaatgagttgaagaaatttgtgaatccaaacacggttaggattgtgagcagcattgaagaagcggactttgtcataacagatacgtttgagcatcagcacaaccaaagaccgattttcttttttcaacacttccactctgttgatgaatggaaaaaattgatctcagccattaatgaggagttactcttccgcgcatttaacggctaaaaagtcattgaagcagggcaatcaagtcctgcttttttctttgtgaaaaagcatgttgtgacgactttcatcagccgttttaattttttcgtcacaagtcactcgaaatgtcatagaaaataaaattgtaccaggttggacgatgttgatgaattgtgaataaaacgttttaaaacctttaatggttttcacatatttgcataatggattcaaaaacgtgacgtgagtttaatagagcgttttgtcaaaatatatccaggcgttggaggaggtataacggttgaaaggaatttgataatgggaaagtttaaaaataggaaatggctgattgggcttttgctactgctgatcctgatcgtaggcggagcggtagtgtggcataacatcacaaataaaggcggtgtccagagcgagttaatagcgaatgcaaaagacgctcgcaaaatgtcgaaagaccagttggtcaaatacgctcaaagtaaggctgatgcatcacagttcaatttgcaagtgtatccaaatgcagagatacataaagacatctcaaagggatatttgtatgtgaaaaattcgccgaagaataagtacgcaatcgatatcgatttagtcgacgacaaaacaaaaaagacaatttactcatcgggactaattcaaccaggatacgaagtgacaaattttgggctgaccaaaaaagccaaagcacttgccaatggtgctaggaacggcacaattcgtgtgaagatttacaatcgcgacactcataaattggaaggtgttacggcagccacagtaaaaattaatgttaattaagcaatttttggaggatatgaacatgaagaagacagtaggattttttgcagcagcggttttgggaacgatgatgatgtcaatgcctgtatcagcggaccaaacaatcaacaatggtgccactggttcaacgaccgacacggccgacatgacggttacgggaatcgtcggtgcaatggataacacggaccctaatgaaaacattcctgatggagatgcccgttggatcaacgtaacgttgccaacttcagcattgtttaattctaatccagcaacgagcaacgcaactttgatggcaccagattatgcaatcaagaataattcaggtcgtcctgttcgtgttgccttgaatgatgttaagaataattctcaaacaactatcaaggccgttaagaatgtgacccttgaaggaaagacgcacggcaaaacaacacaagatatcatcttggacggtgtgccacaaagtccatcagcacctgtaaagttggccgatttgggtgacaaccaaggcaagattaacggtcaagatgtgtctgacacgttctcattcacatttacgggaaatgttgatacgacgttgttaggcacaactaaggaaacggttgactatggtttgacatttaagttcacgccgttgaagtcagatggtactatcgcttaattgtgactgcggctaaggcggggatatgagaaaaaaggttatccgaagcactgtagggatgtgtttgtcattgtttgtgatattttttgtgtttatggtggcgcaatatgtttatgaccaggttatagtcaatcaaaagcacaccgttcaagttactaaacaaggtaagtctcaaatgcaaatctaccaaaatggtacgaccgccacaactgaaacgaatttacccacgcaagaggaggtcgattcacgtttgcaacaagattttgaaacgtttaaggggcaaggataacgttcgtgcctattcattatctgcatttggtaatgttttgcgattaacacacgacaatagcacgcagcaaattgatcccgcgtatagcggagaatacatgaaaatccagcttttccgtgcgacgacggatccactgaatgaactcgagggaaagtactacccagttgtctcgtccagttataaaggaacagaaaaagttagcaacattgaacaaaataagcagtttaccaatttgctacaagctggagatatcgttcatttattcgttaaagatagaactcgcgttaccagttacgttgagaatgtcaaacaaaattcgattgatacgcgttctggtgagcgggttaaaaactttgtgtgggatgggtctgattttaaagaattgtatgtacagtctctcgaagtaaacaatgaaccaaccatttctgtcgggatgagtcatagtgatcttgataaattggtcgaaagttatgtgccggatttgaagtatttccgcgttggtggtgttgaagtacacggtttttctcaatatccagatacttcaaaagaaggatcgaccaaagcaaaaattcgggtcaaacaatatgttggtggccgttggtattaaaacgatttagagattccgttcaaggtaaagaaagccatttctaaagttgctcttatgctagatttacggacagatttttctctgccctgtaaactaatagtagaggagcattttttatatgattcgatattcaccagaatttaagcaatctcttgtcgagatgcacaaccaagggcgttctttcgacaaaatgatactcattgaagatgtccaccagtcgattgaggttgtttttgagcaaaattaaagcactcccaattgatgagaatgcttgctcgttatattctgtaatgttcagcgtccctatatgtgctggtacatctgtaatcatgccaacatcgtagaacgcctggtaaatctgttgtgctgtatcatcagccccagaaatacgcttaggtaattccaatatcatttacttcaccacctttgttgtcagtacacctttatcatcaacctgcaactgatacttggtaccattcgggctggtcaacaccactgtgctcaagtcaggcttaccttcaatagcttgccagtgtgtatacgcataagccttatttccatcggggtcagcatattgcacgatcggcgtgctcttaggtggctcaggcgctggttcggggtctggtgtcacacggtctgacttagcataggcttgccatgctgcggtgtcaccataaaatttgttcaaatcaagattgccatcatagccacttaggcgccccgttgaagcgtattggaatattgctggcccactccatgagccataaccattagcgtccgtccaagggtcatcttggtacccagtggggtttgaatctgcgtattgggcgacccagagaccataattggcactcaccgttgaccattcataactgtttgtgcctgacttgctcatgtaaatcaatggcctgataccagtttgttggtacacgtaatccaaaaaggccttagcgtaaccaacaccttgcgttacaacagcaccttcccagtccaacaccaagatggcctctccaagatacccttgaacgttactgaggaagaactttgcctcttccacagcaccagcacctgttgcaaagtggtacacacctaacaaccggcctgctgacttagcgccttggtactgcgtatcagcttcgggtgatacataggcggttccctcggtggctttaatgatgacgaaatcagcagggacagcacttaggttaatgccagcctgccaattgcttatgtcgattccatttaatgtcattagctgaccacctttccgataacccacatgttacctgttgttcctgtattcctttttgctgtgttgactgcggactgttgtaccttttgggcgtcaaggaaattcttgcgggtgttgttcaacgtaatctgaactgctgatgtcgcaaacggtgctcttacaatgctgaccacttcaactgaagtctggaacccgttatcaagcatctgtactgcccaattttcacccaaaacaacgtcttcattaccagctgatgtaactgtcatagccaacgagggctccaatacaaatgactgagaagccaagttcttcatggcgtctgttgaagtaatcttgtcactttcaacccttgcaccctctttaattccccacttagcaactgaatctgcgttctgtaccttgaagggtgtaaacgctggtttctctgcagttgatacagcttgcacggtattcacaatgctggttgcgtcatactgtagctggactgcggaggtatcattgcggtatcgaaataccttatgagtgttcttaacatatgaatctttgtcgtacaagtgaatgaccttgttatcaggtacgatggcatatagtccaaatgcacccttgatcgttgacaacccttcgatgattgaagtattcccgaaatctgttagcgtcttgttgctgttgaatttaccatgaatctgataagaataaccatcaccgatacctgtgaacagaaacttcaaggcgtctgtcagactgaatgaattatcaccctgtctaacgttgtactggaaacgattgttgagctggtaaaagatgtgcgttgccgtaactgttacgttgtgaacgccaccagtgttgtcatcagtcacctgcttaattacgtaggtttgaccgtcatacttaaccaagttctctacttgcagcaacgcaaatcccagtgaaccatcgtcatacgcttggaaatcaacttggtaagcttcattcttcgtacgggtgagctgaaacgtgctgaaattcaatgaggataacgcttgtgtggacttgccgtccctcgattggataacaaccttatctttgctgtacgccatttagaagtacaagaatgggaagctgaaggtaacattagcactgcttagtccacttaaacgaatgtcattatctccacgttccaactctatgtgcccaaagtccgtgtctacgtcagttgacccattcagtgttggtattacaccattcaatacgaacgtgtcactgttagccatcgccttattcagcgtgatactggtgccattcgtctgatttgtcaaagtaaatgcacccgaaccttttaccgtaatcaccagatcatggtggttaacgtatgggtcaatggccacatctgaagggttgtaaatgttgaactgattactggtaccaacatagctcaacggcctggctggtagattcataccgaaccccaaactgcctaagtcatcaggtaacttatctgacctgaccaaactctgtgccagtccacttggattggtgaacacaaggtctaccgtcccttgtgatgaagcttgaatcggtgtgatgtcagttgggttagccattacccaaaacgtcttaaatggttcctgcgtgcttctaaggcgtattagaccacgctggtaaaagacacggtttaactctgccttaagcaacctgaaatcagccatgttgcgccccttaataaacaatgacacggtgacttgattagatccataagtggcattctgtaaccgttggccgtctgagccggctatggttagccagtcacctgttaattggggtgctgatgacttcatatccagaaacttcacagacggaagtctggccgtcaagtcatattcttggccaccgtagggctgtacgaatagtttcataacgggaatatcctttcgttatattgattgataattgtgtgttgcttgagccatacccatctggttcatcaggttaggtaagttgataccaccttgagcctgcatagccttgagttggtcttggttaacgccaagcatgagtgacaataacgtgattacgttgtcgaacttttgctccaactgtgctgtatcagactgaaccacaatctgttgttcttgtgcaccattgatacgctggttagcttctgcaagtaattggttggctcgtggcttacgtgatggattcattgggataaccacttctgggaacccttcttcacccatttctgcaaacgtgcgtgagttaatccaaccgccatctgcaaaacgcttagcaccccaaggtccccaaccacgcttaacaccagttggtgccaaagctgaacgccaatccaccatgttaaacactgcaaggaactggtctaaggctgacagaatgttgttgtgccctgggtacttccaagcattaaacgtcccaaccttatattggaacagtcctcgtggcttaccagtaccatcatggtcatcgtaacctgtgttgatacttgggttaacatttgactcgaacatggcctgtgaccacaactgcgctaagtctgcacctgacaagtgttctccaattatgtcggccgctttacgggctgtcttattgaaggattcctttgacatagcaccttcaccggcttgtgcaaccacgtcttcatcttcgtgcttcttcttcaaagacttgaacatgttgacgattggatctgcaataccttgaaccaatccattggccatagctggtgcgatgttagttaccagagggcttcctgtgataccagataccgccttgttcataacattacccaaagccttgattgggtgtgcgatgaactctgttagcttgtcccacttgtctttaatccagccaattgctgtatcaagccagttatcagtaccattggcaaacttaggtagggcatgggctggtataacagtttcaccacctgagaagttgaccagtctgttgcgaccttcaagcacagtggcacgcccagagttatcaatgattgcttcttggtaatgttctcctggagcatcgttaacgattgccaaccccttaggcgcaccctttgtaccattagcaaacttcggaatcttaccgatgacttccttcttaccaccaaaagtatggataactgtgttgataccaccaataccattgttgatgacactgataacgttattgataccatcacgggcaaagtcctttaagccgttccacatgtcagaccagaatcctgataccctatccttaatacgcccaaataagttccaaactgagctaccgaagttctcaattccgtgcttgatagaaccagccttcttaccgaagattgactctacatagtcccacagtgcattccagatacctccaatatctttaccaagatttacccagttccctgtaaagaaatcagtaaacagtctcaaccccttcttatagacattgaggtttttatcaaatgcgtttcctacgtaattccacgttgtattccaagctctgctaatgccatcagtaaatgaatgccagcctttactgaagctcttgttgaatgaactaaaccctttggtcaccgaagaccatgtgttaccaaaccacttagtaaccccactaaagaagttcttagatgatttgacaatgccatcaacgaaggtacggaactttttactgtgcttgtataaggcagtaaacgcaacagccagcgctacgaatccagctatccataatgtcgcagggtttgccgccatgaacgtcccaatagacttcaagactggcaatagggtcttaatgcttttaattacaccggaaacgctcgaaacaactttgcttccaaaatgaagtgctagaataccagtcaacaccgctgtaatagctttaccatgttttgctacaaagttaaccactggcgtgattgccttaatgattgctggcatgttctttaccatggtgtcaataaagttcttaacagctttttggagtggctctaacgccttcttaaacttcttagtctcagtggcggacattgttactgaactgacagatgcctccgctgagcgcttcatcaactcaaacgggttagactccttcagttggtcagatgtcttcttagcagtacccgaaacgttgtcaaaggctttgttctgcttaccaagtgactcaagtaccttaagtgagttatcctcacccaaagctgaccacagattagaagcaagtgtggcttctttctgtttgtcggtcatcttacccatctcaccagtgatttgcttgaacatatcaccagctgtgaccttaccgtccttatatccttggaacatgtcctgagacttcttagagaatgaggaaattgcttcgtccatacgaccatcgttcaagctgatagagaactccttggtgaagtccagcaacttgtcaccgttataagcaccggtcttgataccattggcgatcatgctgaaggaatctttagcactcaaccccatttgaccaagcacctgtgaatattcagccatgttgtcggaaatctctccacccacgtcaccaccttgcttctgcaaagtgaacaaattgtcgaagtattcttggtagctcatgttccatgcttttgtagcattctgggcacccttcaatacttcttcagtatcagcgccagaagcctttgaatattgtgttaccagcttcgtttgctctgccagttcaccaacctcagcctttgggttcatttgcttcaacttggtgtaagtttcagtcaaatcttcaactgattcaccgtaaccttgggcatacagcttgttgatagctgcgacagcttccttagattccttgtaagagcctgttgtcttagcttgtaaagctgatacttgtgactgttgatcatagacagccgacactagtttagacacaccagctagtgcagcacctgcagctgtaacggtggccgtaagccccaatttggtcttatcaactgcgccagttagtttctcaaacttcccacccgcttcggtagcgccttcgttttttccaattttagattgtcctaaatccaattcttcaaggctttgcttacccttagcaattgacgtggctgtcttatccaaggcaatcttttgtttgctgattgactcacttgaagcgtcaccagacttaaccatcttatccagttgcttgcgctgggcttcgtagagatctgattgcttgcttagggtgcgtgataggccttccttttgagctttgaggccttcttcttccttaccctcggccttcaatcgttcaacgtaagcgtctgtctctttgatggactgttgaatttccttattaagcccagcaattccagattcctgcaactcataagcccgcttggcctgctcttgttgcttggtcattgaagccagttgacgctctgccgtggttatctgtgaagcatacttctgataagtagcttcacaagcttccgtggaacggttaacttcggcctgttcttgtcgcaacttttgaagcacatcttgttgcttttcaactgactgggacaatcctttgtacttagcctcactggcgccaatttcatcaccagaagccttcatctgtgattccatttgcttccactcattcgtggagtccttaacggctgacttcaactggttcagtgattccgtggctttattggtgttcaagccaatctccgtcgacattaagccggctactttttcttttgccatgtgtacctcctttctttttttatccaagtgattgatacaggttcatcatggcgtctgggttctgcattttgtcgtcttctgaagcgttcatgacttccatcaactccgcataatcagcttcttcgatgtcatctaaagaccagtgcaagttctgcatggtatctttttcaaacattcttagatcagccagatggtttgtgtatgccatcacccgctcaatcggggttactctaaaccctcatcatcagttttcgtcaaagccttcttaatctcagcttctgacattcccataagacgcatgttcaagcgttgtgcaattgccataacgtcctcttggcccaagtcttcaagtgcttcaatctcgtccggcttaagcttcaacatgtcgacaacgtattccgtaacgccgtccagtgcgcccagcacagcttgtagagattcaactggtgcgtcctcttgcatagaatcttccagcgtggccagcttcaattgaatggcatatgtcttcttcaaattcttgacactggccttaacttcaaatggggttttgcgcagttctttaaatgcaatcttcatggttttaccttctctcgtatatgtacttgtcaattgggcttctcaccccgtttgagcctctttattgtcgtggctgtaggacaattggaacgaccttatacgccgctgggcgtggcagacgttgaaccgcctgttacaccaaacacatcagcttgcatggctgccttatcgaacttagcgtcaatgtctgaataaaccttcatcgcttcattgttccatgcttcaacaccgaatgatgtaaatgtcaaagcgtcgtcaacacgaacctcgttgtttgtatcagtttgcaagttggccgcagtctcttgtacctcaccgttagcaaatccaaaccaaattgagttagtacgcttgatgttttgcgcctcaatcgtcatagcaactcgtgggcggtcaccttgtaggaatccacccttaccatctgaaattcgacctaacagcttttgcttaatgtcgaatggtaggtcattaaagtccaaagcaactgatggctcacccttcgtttgtgtttggtcaaccttggtgttgttaccataaatggcagtaccgtttgctgaaatgttagtaatgttagcgctctttgaaccaagcattgctgtggttacggggaatagaccgtctgctgacaatcctgcgtcacccttcaaaagttctccagtttccttatcacgcaatgccaacgtaataagcttcaatcctgcaattgccatgtattaattcctttcaataaaaaatgagccaaccgttattggtcaagctcatcaagtgtcattgtcttatttacttcgatatttttaatcatttgctgtccatcggtttggcttatatccaagtaccgtggctggctgtctgtaatacgccatgcgaagctctctaaggccttgtacagcgttatctctttaccaataaggttctcttcgtcgagcccgtagaatacctgcaaacggtacccaaaagccatctcgttgaatgtattaccaccatatgttgtgatgtctgagttgctctcagtgatcagcacttgggtgacattcttatcatcgatgacctcttcgggaatagcataaaagaatacttgccaatctgggaatactgaatgaaccacgtctttaatctctgccactggtaccattacctgttcctcctatcgataatctgcttgtatacttctgcctgagcttcaacaatcttagcctgcaactgtgagtcattgcgcaagttagcgatggtatgatcgccgttgatagcgacctggccacctttcttatacttacgtccttttgcggtatacattggaaacttcgtaccattctcaatgaaattagcaatgtaagctttatcctttgataacccaactgttgagctaccgttcttcatgccatctacgttggtattttgagcaataactgaatcagccaaatgtgggtctttacccgttgtgcgatgacggtagtggttagccttgtattggtcttcaagctccttggcaaacacatcagcgcctgccttagtaaccttttgcttatcctcaaccgtcatctctgttgatactgcttcagtgtcttcaataaaagcattcaagattgattccaaagattcctctcccatacctatgccctccgcttcaatgtaacgaagtcatacgtaataatggcgttagattcatctggtgcgtattgcacaacgtcgtacatcacaccgtcaatctgggctaccttaataccttccacagcggtgttatggcgtaccatgatgaccttggtgttatccaattctgtaccttgaatttgatactgttgatttaacgtgcgggtcttgggtgcataccacagactgaactgttttacgaagctctttttgattgagccattatcagggttctggactgattccacagtgccgaagtctgccttacggttgaaatctgctggtttagttgtcaccatgcttcaccccctgatattttgcacgtaattgattcaacatgatttgaataccagccccgtatccgttgctcaattcacggtcataatacaatttagtggccaaagtttggataagacggttaaacacgttgcctgacaagctcaacaactcatcttcccccacctcatcagagatagaacctcggataatcgctgaagcgtcatcaatcaaactttcaactgtctttgtttcttcgtcgcttggatcaatgtggagttcttctaacaattgtgctgcattaatacgttccatcattttctccttaatgcccgccccttacggtactgttatctttcgcaggcgattagtccgtcagactacttagtcgtatcaccatcagttgtgttcgtaccggctgatgcatcgacagcttcttggctacccttaatgttgataatcaagtccttgcgtgcttgtacaacgtcttcacgcaaaaagatacccaattgcttgtaccaaatgtcgtacgtgtcttggaattgacctgtaatctctgccaacttaaagttgataacagccttcttcaacggtgcaacaacagcgttgatgtcacctgacttagccttgggcaacaatgtgtcttcaacaacaataacttgcttacccaacacaacttcaccagtagcgcttgcgatagatggttgcaacattggtcgtcccatagcgtccttgatttgatccaaagcgttataggcagattgtgacaaaacgattgaggcattcttcttatcaaccggcttcaagttaacattcaaagccgtcttcaaatcagctacaaagtccttagacacaactggagtaatgccagtagtaagcgccgtcataatcaagccgtcatcagtgttatcacgcagctcaatcaattgaccttgcaactcaccttgccagtcataagccgagtctgaaatcagctcttgtgagaacacgtaggcacccgtgtacgtatgcaagtcccacttaactggcgtaatcacagaaggcttgttcgcagcagtttctgaatattcagtgtgctccttcaaagtgtccttagtgttatcgaacaccggcaacttaccagtcgtagtcgtaacggtaatgttgcgaatcaattgacccaaacgtgggaattggttttcctcatgctctggtggcaaaatcgtttcagggataatgacagcaccatctgacaatgccaatcccgttacgtcacgcttctcacctgtcttcaagaacgtctcgaatgcttgttccgtcgtgttctttgcgtctactacatctaccttcataattccttctccatttcgtgtttcagtgtctgggccttcatctgcaactacttcgtcatctgatggttcttcaacgtcgtcaggttcatctgctcgttgttccggttccttttcagtagcatcttcatctgttgtttccaaccctgctgcttgctccaaaactgcaatttcttccttcagcttctcaatctcggcttccttgtccttgatgtctgacatgcccgctttcacttcatccgtcgtcttgtctgcgtcatcaacaaacgcacgaacttcaatcttcttgttgttaagggcttgttgctttgtagccaaatctcccttaagctctgcaatcttattcatctgtttctcctagataaatccgcactttctctcggtactcgtgctcgttttgtgcatcaaaaaaagcgctcaatgaacgggtcacttgaacgcttgtatcgtcatatgcaggtacgcttactacgctaatttctttcaactctgcaatcttattaataattcgggtgggcttttcgccttgcttccattcatcaccacccttggcaacgacgaacccaaaactcatgccctttaagtttcccaacttgacgttgttataaacgtcccgtcccaacgtcgtgtcgggaacatcaagtacaaaatgtaagccaacatcatcaacatgcaaacccaacgtaccggcatcaactcgtcccaataacgaagcatagtcgtgttcaaaaagcgctaacacttccgttaggtcaacaccattcaaagcaccagtacgaatatattcaatgaacggcccacgactaactgacggtttgtcgaacttaagtgcatatcctgcaatctgtccaacaaacttgccatcagaacttgaacgaacttccaactcaccaatatcaacatagtgttgttcaatatctgtcactaaatcaccccctttcgttgtaacaatgccattgcttcttgtgctgacatcatctccctatctacccaatccaaaacatcagccttaagtgttgaatttgaatagtcaataatctgcgacatatccaatttgatgtcaccacccagcttgaaattaagctcggatagcaaaggttcgatataacgattaagtccgccaacatacagcgcactaatctgatccaatgaagattgttggtctccagttccgttcaagtaactatcgggtacaccaaacgccttagcaatctgttcacgaccccaatccatgctagttaggtatttggcaatgtcagcattaatcgaaatagtcgtgaaatcggccgcttggtcaagcaccattactcgcccagcattgtcaccggtattagcacgctcaaattcacgtcttaccgcttccttggcttcttcagtcaacgtaccttgtggaatggttatcttactcgttgggtttatagcacctttgagagttgaaactgtcagcctattagcctgcttttgctgtgcaagttcgttaactaatgactccaacgggctatgcccaatcaacgaccgcaattcatcagccccataagccataatgcgtgcgtgaatgatgtcatttgggctaaactgaccacctgaaaactcaccgaattggttaacaatgtacgtcaactcatcaccattaagttccatagcaacagatgcagccggaacaaatcgcaacttttggttaacacgatcaataatcagaaaaacattcccgttaaacagcaaactcaatacagcagtttgccaaaacgtcacacgattcactcggtcactgggtttattcaacatttcaatgaaaccattaccaccaataaactttgcacctgcaatatcagaactaatcagacttgccacagagtacaagtcactgtttttcaacgcttcatctgcagttaccaactcattcggaatgaatgtcccacctgacatgatgaatggcgctgtgttaccaaccattgccattgccgaccggcgctcaaaaggattgattaagctcattgttcaccaccctttggactgaccatgtaagccagcaaagccaacaacaaaccagtgacaataaagccaaccggaacgctaaataaaaagacgcccacacttacaagtgcgacgcctaacagcaataaaaacagtggtaacactgctaaaaatttattcatgctcgtgtcctcctttctaaaatgaaaaattgttgatgaaataatcgcttatttcgtcatctgtcttgtttccgaatggtaacttgctttgcttttcttccacgttactaaattcagtagcatagaattgtccttcgtaaagcgcattgacaattgcgtcaacaatatcaatcttttgtgagttaacgtttttatcaaccttaattccgttgttatcagagacgataaccgcattaaccagcgcttgttgtaacgcctggtcatcaagcatggtaattcgctgcttaatgaactgctcttgcaaaaacttggttggttcattcaacgatttaataccctgacgtaccggaataattaagtattcactcttaatctcatctagccgtctgatgaagcgacccgttccccattggtcatacaaaatcccttgcacatttagttcgttactctcaataaagttaagcatccagttgaacacctcatcttcatcaatcaaaccaaagcggtcacgtgttacagttgcaaatccctttgcctcaacgtcccgataattgatattgtcgcgctgctccttagcctcaatacttccggccttagcgattggcacccaactgtgttggtacaaatggtaataggtttgcccgtcggttccggtatatggaaatacaaatgctattgccgtatcgtcattagtttgagagaagtcgaaaccaataaacacatcacgtccaaacatactgaagtcatcaacaatagcgtccttaatcaaatcaagcggcaaataagcattatccttagcgttttgccacatgttcatattcttaacgataaagtccggcaacttaccttgcgacgctttagcatcacgttctgtaatcattccttctcgcaagttttttgccatgaacggcaactccataagcgggtttgatttcgcccatagttcaggatagtatgcttcatcttcatcatcttgttcccagatcaaaacaaggtctttatcaatatcattccaattaccggcttcaagatactttgcgtatcgtcggtaatcttcatacattggtgcgtttggatccaaaccggctgttgagatgaaaaacatttgagccagtggattgttaaccattccagaagtcattgaattaatgaactctcgctgaccttggccaaacaagtgatactcatcaacaatacctgtcgtgtaatggtctccatcagaagcactagcctgtgctgacaaacgtttcattgaagttgactgtgaatcaatcctcatttcattttggttatactcaacgccccacttttgagccaacttcttgaacgggccttttttcaactgttcccagttgtacgtcatgtacttatacagcggtttggtgtgtgaaatatcaatacttgatacagcaagctgacgatttactttcggatagccaaacaaaaagttatacagcgtgtatgctgatagcaattgtgtcttaccgttcgttcttgccatgctgatgaaaatattcttaaagcgcatcccctgtgtttcaggatttcgccaaccttgaatcattgccaaaataaaacgctggtaaggtgaagggttaaatggttcacctgacgtcacgtctttaagtaacgtcgcaaactcattaatcttcctagcctcatcagcgtcataaacatagatgaaatcaccatcatcttgaattcttcgtaggtcattgatatgtcgttcagcagctttcttaatcttttcacctgccatctttttgccagtaagaacagcaattgaatattccaaagctgggtcattcggataacgtttaagcaagtcattgtacttttgcatactcaacctccaaacctagcttcccaatccgtatcatcttcatcatcagaatttgccatgtcaatcaacgtcgcacggctttgtggtgatagtcccaaatcgcttccaactgacttaatggcttttgttgcagagtcgataattccaactgctgggtttttgaaatatttctcaccggctttgtacaagatgcctaacttcttaactgaatcatatgcttcacgcaacatctgataattcattgccagagtttcaactgctgaactatctgcgttaatgacataccctgacttattcaagaacggcacaatcgtctcccacattttctttgcctcgccagttaagtgcttaggtgccttttcaggcaacttatcggctgtttcaactgatttatgcaacttttcagtgcgatcacgctggtcttttcggtcattttctgaacttgtaacctttgcttttcgtggcacgatctcacctcctttcaatttaaaaaataataataactgcagcgtgttgaagagacggcactatttgatattcggttacttcctaagcgatgcaggcgggggtataaacgattttcaattatcaatcagctaatcactctatgaaatataaaacgtctcacacgcgctcctatggcttctcacgcaatacgttgccccaccagtcacgacttgcatgcttcaacacattttcattcaacttcttttcaactgctgtcttgtgattgtgttgtgctccagtcagtaaccataagttacttgtgtctagctgcttatctttagttagcagtcgtcttggtatgatgtggtccactatcaactcaccgtcatcccataacctaccgtcaattgcgtcagcatatccatcacggctcttaacgtatgcacttatcttcttccactgctttgtgttatagaagccatcatgaagctcttgtcgccttgtgctgtcgtactcctttgttgcctgtgctagttcatgctgtccgcgtaacgtctgagcattgcggtctgcattcatctgcttagcatgtacatacttcttcatgcgtgcttcataatgtggctggcaatatgtccaacctagtttaatcaactcaaggcaaccaatctctgcacacctatgcattctcatatcacagttgcctggcgaaatgccttagatcgaccactcttgtcagtcaaatcaaaataattgatgttaaattctttatgattttcggtctctgtatctgtattccaatcaaccataaggctaattaatgccttttcattaatttcatcaatcaactcgccatctacaaacacatttggtacatcacgaatgtcatcaaactcaatccgtacgtgtggttgctctgctgtacgatcctcatcaacaccgtaaatgtatgtgtactccccacgattaatatcgttactcttgatgtgcttaaacattaagttcttgttcatatcaatacctcattaattactaatggttttggtctcttatcctgttttcctatgatagacagattaacaacataaaaaatgatacggccgaaacaataacaaatgaccaaaaccatgcttttaaatcttctaattctgaacgtgttgccagtttttcataatttaaatcgctaattttccgatttaacattttaatatcattggataggatattaatgttatgttcagcatactcatcagtatgttccaaatatctaacttgattatcaacgtaatcatgaatctctttggagagtttacgcttctcaatcgatgcagtagtttcgccggtgattgtggtgttattacctttaatattcatgccatcattggtcacctcaataatggttccattttcaaactcataccttcccatatttgttactccttttcagtgcaaaataaaaaggctacccaatcggataacctttgttgtttattcttctatcattgctggatactcatagttcatctttagtaacatctctgaaaacttaatcattttttgagcatcttctttagtatttactataatttcatgtgtcgcagtatttccaaattttctaatagaatcaatccaattatcgctattagccgaaacataatggtgatcttttaaatagtccacataataaacaaagttgcggttttcttcagcaccaaaattgacacctacatgcataagaagttttctacaaagcaaaatagttccagtatacgaaccaactgaataagattttctagcctcttcgtacacattgttcacttcatcagggacgttttcaaccgtattcccaaaattatcaccaggaacttgaatatcattataaataaatgttggcatatgacaattcgtgcagatatatacaccttgagctttatcatttttactaacactctgactgtaaacaatgtttaaaggcattcctttatcgcttgttacatgcatcccgcaatatccacatgtaaaactggcattcattatgtgttctcctttccatatcacaccgtctttgtctgtttcatataaatcagccattataactctccttagaagtttattattaattaactgattatatcaaaaattcactttgtttgattttatatacgcaagtggttaggatttgcacctaacaacttgaaattatctaatagtttctaaccgagtatttgtcgagccactaatggttattcaacaacactcgggctttacctattccgccacacttgctttattttaactttggtactctatcataataacttggactgcacgcacctcgcatgcgacacttacgaatcatatacgcgatgtcgatttttacatcaaaataaaaaaaagatagtaacctaatgattactatctttttttaatattttgaaaaaacgttacttaactaagactgcttggctagctgatagccaaacggtacggctacccatcttaacttgaataccattacttggcttgtcaacttttagcacggaatacttaccagtaacttttgcatagtcgcctaccgctagtgtttggttagcagttgttactccactagcgttagtctttgttaatggtgtaggatcaatccagttatttgcggttgatgcacctcctgatagcgtatctgaagccactaggttatgtgcagcatcaaccttagaaatcttgtaaaccttagggaaggttacaacagatcccacttgtatatttgaagtgttaccagtatttgatccactatttccaggatttgtcgtcgacccatttgtaaaaggtggtcgaacccatccaacgatattcattccccagctttgcaaacttgcataagtcgcagtatgttttacagtacttttaacattgttaaagttttcgtcggcccaagtgatagaagaagaatttgcagaaattacaactcctgtatgcccaacgccattaccgctaacatcaaacacgacaatatcgccggcttgtggtatagcactacctgtcttatggatgactttgaatccgttgacattacctgtcttcattaaatccaaagctacaccacctgaaaagtgtgtcccaaaatttgtttgtgcatactgattaacataatcaaagcattgaacaccatacgcgtgatcaaaatcatatgattttcccaaagaactgttaacccatgataacgattggctttgcgaatttgctgatacactcaagtttgctccaccaataacggacactgagacagcaaacgttatagcaagtgacttaccccatgcatgaatggccattaaaatactcctccaaatttatttaattgttattgaatcaacccgatagcgtgagaagtatatcacgacttttaatgaaatttatattaatcctgaataaagtacaaagctgtatgtaggtcctttttcaaattattctttaactcgcaaatcataaacatcggaaaaattgtcagcaaacaatagaaatgcctcttcgataatctcttggccacgccgtgtgctgtaatcagtgagctcttccactttcaaccattctaagtggcgaacgtatcgcaaccacatgaaatgcctgtgtggctgtgtcataaccttgatggcatggacaacggcatcgtagtagtgcacagcgtcagtatgattcgccaaccgttcatcgttggcatttccaaatgatcgcgcacttggcatgtctgaaatttcaactgacttcaaatcaacatatcccatatcagccatgttcacgatacgtggccactcactatcaaaaaactctcgaaccgcttctcttgcaacagtcgcatcaactcacgcactgattggcttcaggccgcctagaccaatgtctggtttacttaatcacggttatcggcactagccggcacgacgccgtttataagccgtcacttgtgaatttcaaaaattcgccttgtgaaggcttatttgttgcacgatacaacttgtgaaatccggatggttcacaatctataccacctgttttctctcaccggcaggtctcggccctgttctacctacaaaaacaccgagaaatgacgcctttttaagctgaaatccgggttttgaaaaattttcggagcccggcacctctcggtgccgaaaaaacctgtccataatcttgacatcagcgccagacagtcatgttcaaataatctactatccgcttataactcgctaatcatttttttgatagatttcaatgagtcataatcaaatacctgtacaggttgatccattctttttatatctattcctgttggtgggtaactagttccttcgggtttaagtattgctatcctgtattctctttggcctttatatttcaatctctttcggaatattaaagacacagcatcttcatctctaaacggttcatctgtatattctataggtccgctatatgccttgtcatagttgtcttgctctgaaagaaaattcgttacacttctttttaatgaactcagttcaataagcatgaatggtctcccgttagctatatcactaacatcttcgataaattcactacttatatgtccgtcttcatcaaaatcagtatcttaatttaaaattacaaacgaactgatgtaacataattctggattactcagtctctttgttacactagctgtttggtaatcaatttcaacttgctttcctgtttcgggaattctcatgagcaggacttctttttttctatcaaacaactctatagctttaccttctagtaaatctgcctgagcttctgttaagccttcaagttcacatgtaaacttatacgctagagtcgttgcccattttttaatatgctgaaaagaaacgctttttcttaattggtgtttggcgctgacgagataaacgctcaccgttgaccaacgccttggcgttatcatcaaattgctttgctgaatcagagccatatgctgcttttagtttatcgaatgcagctgtcatttcatatttgcgacctgaaatattgtgtgcatctgatgcaaacaagtgtgccaaaccattagcaatgatatcttcactaaaggccgtcaccgctttaccaaatgtaccaacatatgaactagcggtcacttgtgcatatgccccacgtgacaccatgtcatacaacaattgtggttcctccattagacgcgtgttacgttctgggtgcacaatgattggcaccaaaccgcgttgttggatttggaacaacatatccatcgtaaatgctggtacatcatctgatgggaattcgattaagatgtaagttccctgctcatctgttgtgagaatgtcgccgtcatccaacgctgacaataagccaccattgatgcgaacttcttgcgatggaaaaaccgtcaatggaatattcgcattgttcaattcagtttgaaaatcagccgttaacttaatcacgtctgatgcatgattcacataacgtccgttcatatggtgtggtgtcataagtgagtgtgtcacgccatctgcaaccgcatcgcgcgccatctgcaacgaaatttcaagactctctgacccatcgtcaataccgggtaataaatgactgtgaatatcgatcatgtccgtctccttaaaccttttctctttctttgactataccctaatcattcacggaatgttatataattattcatgttttgaatacattttaaggagttttcccatgattaaaaaggtgttactttggattttgggtatcgctgttaccctgattgtgattggtggtggcatcgctgcattcgcgctacacaacacgacctcgaagattcactcgatggatagcacattaagtaaagcttcagatacgaagaccaaagctgggaaatcagtcgcttacctactcctcggtacggacactggtgctctaggacgaaactacaagggtcgtaccgatacaatgatggttatggttgtcaacccaacttcaaaaaccacaacaatgatttcgattgaacgtgacaccaagattcaaatcgacggtgttgatgcaaagcttaatgcggcgtacgcatacggtaacgctgaagctgcagtaaacgcggtcgataagttacttaatatcaagctagatggttacctcctggttaacatgaatggtttgaagcaacttgttaatgccgttggcggtgtcgatgtaaagtcaccattaacatttgactatgagggttattcattcacagaaggtcaaacgtaccacatggatggtgcacaagcattgcaattctcacgcatgcgttacgacgatccacaaggagactacggtcgacaaattcgccaacaactcgtgattgaatcagtaattaataagctgaaagatgatccttctagcgttctctcaaacgatttcctaaatgcagtatctgacaatgttcgttcaaacatttcgcttacttcattacgtaacttagccactaagtatcgtgattctgctcaaaccattaaccgtgatcaaatgactggtactggtgtgatgattgatggcgtttcttaccaagaaatgtctcaagatgagattactcgtgttcataatgaaattatagatgcaactaactaatttatcaccaataaaaaggcatcgcacaaactaacccaaaggtcggcttgtgcgatgccttttttacgttcgtaatcaattcgtaccctaaaaagtaatacgcttaattgaacagacgcttttttaatacccaaaaatagttgcttcggccaaacattatgataatcattgcagcgcttaccaaaatcatcgtggcaacttttcccattattgaaattaacgaattaccacccaagtattcctcgcctaaataaccaaggaaagtttgaataccgaatagcactccaaacttacacaatagttctgacacaccttgaaaatttcctttcaaaggatacttgtaaataacgaatggttctatccatgatacagtcattgctgtggacagtatcgttccaagcaataccccattcacccccagattaaacggaccaacgaacagcaacgttaagaaaatatttacaaaagactctatgatcgacttccacctctgaacccattgcaatccaaaagcatcaatgtatatccaaaatggcacacgaactaactgcaaaataagcacaatagaaatcaaagtttccgtgtgaacagcaaatacagatttttctcctacccacatgcgcataaatggcgaaagtacaactaaataaattgcatatccacccgctattaatgtatacaaaataaaaattacttctgttaatacaattctatttttttcagaatctctttcaacacctaaatgtccaatactcggggttaatgcgctggaaactttttgcagaattgtctgtatcgcattcgttattactgaataatttgaatagataccaacagtggctagattagtaaatagcgacaaaataatattatcactaccaaaaacgatcaagctccctattttacttgaaaacccaccaaccgcatttttaaaaattttagatttttctgcagaatcaagaataactcggtcagtaaccttcaaaaaaggaaactcatgccgcgcaattacagtaataattacattcaaaacaatagttccaattagttgtatagacacatacaaaaccggatttttaaaaatcattaagctaatcagctgagccagatttacaactacaaagctaagcgaagttactccattcacaatatacccttgctggtttgcatttaatacagatcgattataaccaagcaaataacttgaaactgtattcgctagaaataaaaagtatatggtataaacgtccggtaatttcatgcctgcattccctattatttcaggcaaaaacgctactaaaattactcctaaaacagttacaataattgcaatccatctaaaagtattcctgtaaagtcgcatgaccgctgtgattttttttgcatctttttcttttaatggctgaaaaagagtgtacacaaagacagaatccaatcctaaatcaactagtgacaacattgacaaagtgcttgttaatacgccatttaatcctaggtaatcgttacctaacttttgaatgaacaccacacgtacaatcatcgaaagaaacaactgtacaaaataagttattaacgtaaccattacatttaattttgcacgcttagttctattcattttttaacgtattcctatctgccgaaactttattaattaattgagaatattcactcaaaactttcgtcattgaaaaatgactctgtgcggatagtgctttgctttttaaatctttcacgttgtttacagcacccaatacattagcagacaacgtagacacatccgccgtattttcaatcaattcaccgaaacgaccatcttccaaaatctcttccgaaccgccattttttgttgccaagacaggtacaccaaggaccaatgcctctccgataaccgttggataactctcaactagagatgaattaacaaacaagtccgacgactttacataaggcattggattaaacttcatccctaacagaaacacgttactcaaattgttcttattaacaatatccttcaatttattgaaatatgatccattcccaataattgtcaaagaaagtggcatcactgttgattctgatgcattcttgaaagcttctatcaacagatcaaatctttttactgggtccgctcttcctacagagataactctgaatgtattatcagtgagtcgcaaccattctgaatagttatcatcgacaatcaaacttttattttgtatttcccgtgaatcaatcacattatggattatcgtcttgtcagtatttacttgtggaaatttagacataaatccatttttaccaccttcagacacaaacacaattttgtcgtaactgttgtaaatacgttcttgttgagttattgatctatagctggagtcagcccatggattagtgcttacatcagtatgaatccaagcaatcttgggattcttcttgtatatcgaggcaatgtgagtagagattccctccataaaacttatgaccactgttgaactgtcaactcgatttgtaatctccaatagcttcggcacataaaataaaatccgcttaaacgttgctctatatattttcgaaaacagaccattatcttttggcactaatcctttaatgtctacatcacttgggacttccttaactaattcaccctctaccgtatgcagaatcaaacttacatcatacatttcacgatcgaagtttttcaaaaagctaatcaggactttctcagccccacccatctttaagttccgcatcaaaataacaactttacgcttcattttctatctccttgaagatgtttcgaatgtctttttcagtgacttttctgccattttcagaggataaactagtccaaagtgtagggaaatgattgcgtaacacactttttagactgcttctaaccgactgcttattggattccccccatgaattcataaacaaatgctccgcaaagtttgcttctctatttctagaaaaatatgaaaaataatccaacggcaatattaagatgccatcctggatttcttgtcggacaccagtgttactaaattcaggatataaagtggagaacaagaccgtcataattgggttgtttgtatattcaagcaacaatggctgcatcttagtaaaaacgcgattttcgtacacttgtaacatgttattaataaattcatgattgggttccgccagaataattccagttgcaagactatttttgtacaaataccccatcacaagtcgctttgacaaaaacggagaaaggcttttcttcagttccatatcagtatccaaataaactccaccgtacttgttcaaaacgtctagtctcaacacatcagtcaaatatgcccagtttttggtttcatacatctgctttgaaaacgaatactgtgagaaatcccaattttcttcattccaaagcttaaactcccaatctggtaatatttgcttccagcgttgtactctctcttcaacctctatcggaatttctcgtccaaaccaagcataatgcacaattttaggaatcatacaagttcctcctactctctacctaaaactcttaaaatatagtttaaaaatccaatcattaaggacaacccatgtaaaccaccgaagttcctcaacacattgaacgtccaaaatatagatttaattttattggaagaaagcgaattatgaattctgtatttagcatgcgattcctcaaacaaaaaggcatatttaacttttctaattaacataatccaggctgcgtagtcctcatgatgtgtattcgggaaaagattatcaggaatcacacttcttttcacaacaacggtcagcaaccctgcgggatttcccttcaaaaaatcatccaacgagtatctacccgcaggtaatttccttgccttaaggggtgttccctcatgatccatcgtctcgtagttagtgaacgaaaaagcgatgcctctatccatcattttcgaaacctgcattttcaatttatctggtagccatatatcgtccgagtctaaaaaggcgacatattcaccgcgagacatggatattccaacatttctagtcattgcaacgccttcgttcttcgaattaaatgcggtccttactgttcgattactatattctttgaatttattgattaatcgaacagtataatcggaacttgaatcgtccacgataattatttctaaatcatccaaagtttgattttctactgacaaaagcgtctcccataaagtgtcagcactattgtacgttgggataattacggataccaaagtcacaaacactctccccactttcttctagaatgttcgatagtagacaaatttaacaaaatttttgaatcccttaaagagttcgaaatattttccctgattagaatgtaaaaccttatgaacacgtttgcttaccaaaacagaagaaacatccttatttaatttagcaacccaaaggtagcctacgaagtaggatttaaacgcttcgttcactattctcgggttgctagacatttcaagcacatcatcaagcattatatctaacgaagtcatcttatccataagtttagtttcactagattgcagtgttatgctaccagatctacggtaatacttatacaaaggcaagttgataaatctatacgtatctgaggtattttgtcttaaaaaatccataaaaaaggccaaatcttcgtagtacatttccctaaaagacagttcttttattgcatcagatcggaaaattttagtaggcgcataccctggaacgaatccctgtttaatacccaagagttcagttagaatatcatccttttcaaggatgagctccatttcttgcgacttaattttattcgtaaacgtatttatcgttccatcttcaagaatctcgtcgtatccaaacataatcaagtcatcggaagtgctaagaattgtcttcagtaggatttccgctgcaccttcgctcaaagcgtcgtcggaatcaaaaaaatatacgtagcgtccgccggctaaagaatacccaaaatttcgagctgatgataatccaccattatctttatgatagacggacacattgttatatgtctcttcaatgtgacgagcaactaataagctatcatcagttgacccatcatcgacaatcagtatttcgattgcttcgttatttaaccaacttcctagcgactcgatactacgtagcaggtagttttcaacgttatacgccggtataacaacagttaattcaaatttcatattttgactttttaaagaacttgtcattcaacgttttctccaaattgtgcaatgtagcttcatctctgacgctatcatcatttataactagcatttttacttttgagctcactttgaccggatccttaaaatcacccactgttgtataaaggcctctcaacttacccggcatgaaatttcctttaatatttctgtagtatcttactgcccaatcattgatatccgttgcttctctaaaacgattagcccacgtatttctcagctcaatcaatccaattttttcaaaactcaaaaagtcggactttcggtacgcaattgcaaaatgtggattatagaaacccacaaagccaccatacggaagtgacaataacgttctgacttgcgtcagtccgtattttaaattgaaaaattttcgtaagttttttttcatcacaaagcgcttactaaaaagtttattaacaattgctgtaccgttttgtgagatatgaaaaaatccatcttgaaaaggcacaattgaattttctgctaaaatgtccacgggcatatcattgataaaatagtcctctggattattcatattccacaatacacagtcatcattcagcaatatgaacttttcagataaccccggaattttatagatacttgtaacaatcacatttgaattaaacgtagggagtttcccctcaataaattccgtatgatcaacaactataactttagttaaatccaaccaatctggaaattgcctatcggtcactaaaaatacgttattaacccatggcatatacaattcaatggatctaaataagtatttcagagttccgtaatcctcaaacctgttatttgatttcatttcatctgatgaatcactagcgccattcatatacgagttttttttcatttgccaaacaggatctgacccgtctacccaaggaattacgacatcaattttttctttttcgttcaatattttcatctccaaatcggtgtaattaacatttttccgtaagataacaaatctgtcggtggcaaaaagttaccaggggctgtccaataatacgtgaatccaattaccaaagttaaaatcaccacagccaaatcaatgtaggtgaatttctttgtcttcacaacactaaatatccaaactaccgtcaacatgacccatgcaaatggatatattctttggaacaaaaagaacggcagacttaggccggttaaaatataattgaactcaacgttgtaaaaattagcttttgaaacgtcctgacgaattaaatagaatctagaaaacatcaacgaaactatgatgaaccatcctacataaaattttatcatccactcaaacgtcccagaaaaactatcgccactgacataagcagcaaactgattcaaaacgttgccaaccaagctactatgtaaaaccactacaacacccaaagatactactgcaaaaatcggtaaccaacgcttaataaaactattgttcctagaagatacaattgcggcaaatacctttattccgaggtaaatccatgctgctggatgaaacaatccagccaccacagaccagaataatttaggaatggtaattaattctttatttaaagcatcgctcgccataagcaaaataacaatatcggttgccacataccatctaaacccactaactggcaacttcagtgtcatcataaaaattaatgaaaaatagccaaacgttctgatgaatattgttaaagcatctactttatccgtttcggtaactttagcaatcgcaaacaatctaacaaaaatagataatactacagtaacggctgataataaccgataatctgccgttttcgagatgataaataaaagtactgcagacaaaggccaagtttgcccgttaagcccatactcagacacgggcattgtactgtaaatttgtgaaacaaactcagatataccgttcacatattgaatcgagttcatataggcaacgtatctgaacatgtcgtctgtcggtagatatatataatgcatcgcaaatcctgcaaagcccagtgctatggccaggattgctagaatattagtttttttctcaaagataatcactgcagcaccaaaaataatgccacccattggaaatactacactgagaaatatcgccatcagtcctaaaattacaaccaagggatcactctccattcaaaaaattatgaaaaatgcgatgcagtctcgcatcgcatttcttaatgcgctccgtgtccagtcaataccacagaaagcgtgtgcagaactatgagcaagtcttctttaaagctaatgttgtcaatatactccaaatcatccgccaatttttcactaggtgtggcatcatatcctccacgaatttgcgccaaaccactaagtcccggcgttactcgtaatcttttttcaaatcctggaacttcttcagaaaattgactcgtaaatgatggtcgctctggtcgtggcccaataaaactcatttcaccagaaataacactaaatatctggggtaattcatcaattcttgtcatgcgtacgaaatgtcccatctttgtgattctagaatcattcttttttgcccaaacagcgccagactttgattctgcgtctgtatacatcgatcgaagcttagtaacatatatgacggaacccattttcccaacacgttcctgcttataaaacattggacctggagtgtccattttaattaatacaccaaaaattaaaatcactatcgacgcaggaattgcaaatagaatggcaaaaaccaaatcaaatactcgcttaacaattaaatatccatttctgactggttgaaaatttttaagttttacgaggtaaacttctgaattattatctttcatattttataaactatcccaatattctgcagcacctgcattgaaatcgtacatcggagtgtaacccatagaagtgagcttcgaaatatcagcttcagaatatttaatatcccccagacgctctggttccttctttaacatcagcttcttaccagatgcactctctaatcctttaattgcatcaagcaatgttctagaggttcctgttgcaacgttgaacacttcaccaaccatttgatcattatcttcggctagcttcaaagcggcaactacatctttaacatacacaaaatctcgtgtctgaagcccatcaccgaacaatcggaatacagaattatcttgcaacgcacttgtgataatactcaggacccctgaatatggtgacttaggattttgtcgtggtccataaacattaaaaaagcgaactgctacagctggcaaatcatatagcgcagaatacgttagcaaaaatcgttcagtagcatatttatcaatagcatacgcagttgctggacgcactggcccgtcttctctctttggcaagtcaggcaaagtaccatatgttgcggcagatgaagaaaacagaattctctgtggtcgcaaattgttgattctcaaagactccaaaatagcgatatttgcttcttgattaacttgatgagattcatacggacgctcaatagtgtcggcaacagatgcaattgctgcaagtaagtaaatatagtcaaaattgtacttagcaagcaagtcattcataaacgtcgtgtctgttatacttttttcaaaaaaagttaaattgtcattttcagggagattttccaacaaccccatagataaatcatcaactacaacaacggcatttccttcatttagatgacgttctactacgtgtgatccaataaatccagctccacccgtaaccaatacagttttattcatttcggtatctccattcaaattattcatttccatatccatagccgtaatcataaccatacccataacccgcatcgtttttaccaccacgaacacgttgcacaattcccaaaatcttcgtatctgttaaacgcaacgtttcaaccgtacgttggagattaattttaagtgtcttaccaaacatcgtaaccaaaatagcaccatcgacaagcggcattaaaacatgcggatccgtcacagccattactggtggtacgtcgaggactacgacatcgtaattattacgcatccactcaaccaaagaagccatacgcgctgaacttaatagctctgctggattaggtggcaccggcccagaagtaagaacctctaaattttccacaaacgtcttttgcactgtatctttaggttgtgcgttgctagccaaaatagttgttaatccgcgtatattcaacaaatcgaacgttgaatgtgcagttggacgacgcaaatctgcatcaacataaagaaccttttttccggcttgtgcccacgtaaccgctacgttagatgaaaccgtcgtcttcccatctgatgattcagccgacgtaaacatcaccacttgcaacttgtccaaagctgcaccagcaaattcaatattcgtgcgcaacgtacggaattgctctgaaataacgtgctttggttcaacgaaagtcaccaagcgtgcgccattatcttgtgtctcagtatcgacaacgtgctttttcttcaaaaaattaaaactcatctcttatctcccgttaaatgcgtttaccgatacgtgacgtacgtgtttcattgcttgtattcttcttttcattagctgcaacgacatccttcatatcgcgaatcttaccgatatatccgataaaacctaaattagtcagttttaattcatccgttaggaattccaaatccttaaccgtacgatcagttacttccttaatgaagccccatgcaaatccagcaaatacaccaagtaaaaatccagccaaagtaattaacttaacatttggtgcaacgggctttgaatttgtcattgcttttgaaacaattgatacgtttgaaacagacataattgaagcaactttgtccttgaacacttccgcaattgtattcgcaatatccttagacatcttggcgtcgcctgacttaacattcactgagaaaacttgtgagtttgtctggttagaaatactaatcatcttagccactgaatcagctgttaaatcagtattgtcatatttggcagctaccagcttatacttagccggttgtgcaggtgcagtttgcacctgcttaccataagcatcggtctcatattgagctggtactgccgcttgaatttgttccttgtgtggctttgttaaattattgacgaccgtgttcaaaataattggtcgcgtaataatatccttatatgtattgatgatttgtacatcggcttgttgatctgcgtactgcacacccgctttatcagcatcttgcttgcggttaacaagcatcgccgccgatgaactgtactgagggtgaatcacaaacttagacacaccaaaagcaacgccgccaacaatcaccccaagtgccagcataaacgtccagttacgacgaacaatcaaccatagtcgaccaagattgactacgttatccatataaataaacccacctattctaaattggtaataataccttcaaaaaaattccgtttttcgcaaaataatcgcacacagaaaagacacatttcattatatcactttttaagatagggttaagttaagaacataatcgcataaagtatcacttttacaggtatttatcccattctttaatgatttttatctgtatattcggacctaaattgtacttttgcccattatttctcatatttcggtaaaaaattacagcaatataaaccggacattacggataattatcaataacgtttcgtcaagtccgaaaaccttgtaatttataacaaactattaatattgactacaaaaaagctcttgcaaatcgaaaatgatctgtaggagctgtttacccggattattcatcaagacaaacaaaaacccgctgaaacagcaagttaataccgtttcagcgggttttgcgctttcacccgttgggtgaaaaccatagcagctctttttttctacgctttgtcaacacagatgttgatatatagctattctgatcgttctagtaaatttgatttattcaacttactagaacgattttttgttttaaaaatcttagttttatggtttttgacacacttgaataagccttgagggtataaaaattttttcaaggctgttaagctaactatgacccaagcgttttacaatgagccggccagctcgtatgagtaaaattgattggtggttataaggtaatgaatcgtcttgataaggcgatccattgaggaaacgagtaatggcttctttcgagttgctgttgctcgtttcttttcgtatctatccctaatgtggtttggcttcgcagttgaactaatcatatttacaacggtccaataaagaatctttcgggcatgtgggttaccgtacttggtgatgtgtcgctgtgcgacgtaatcaccagattgaatctccgttaaatcaagtccaataaaactatttaacggagaacgcttttcaaaccgtcgaatatcaccgagttcacggattaggctaaccgcggtattgtcagctattccaggaatgcttaagagaatcttgaattcggtaaggccttcgctacataaaccatgttggcgatgacaatttctcgttccacagtcattttgaggatgtttgtgacttgatgttggagctgtttaactacgaatgatgttgattcaatcgccggataggaaattctgtgggctcgccacagtctttctgctagtgtttgtgcacgtccttggccaataccacgtattcctaatccaagaatgctatccatgatttctgttatcgtattcgtatgtccctcaatcatatctgggtgtggaaataaacgaagaacttctagacttgaggttttatccacatcaatttcatctgtgaaattgggaaatgaaaactgaatcaatttatgaacgcggtttttctcgcgctttatatcttcagtttgttggtcgtaatatcgactcatgtctgacagctcaccatacaagggatctgagaaacggggcacgtaaggcactggttccttggtgaattctgttatggcaaggcctcgtgcgtcacgaacgtcgttcttgcgcattcgggatccatcatccagacgcttcttagctactaggggattaagtatgtgatacagaatgctgttgtcgataagatatttctctagtcgacgtgagtagacgccggttgcctctaagacgacctccggaccacgataggattggataattgactttaaactttgaaacccaatggcatcgagagtgatatcaccgttgtaagttgtttttccatctactgctacagataactttgcggatgcctttgaaacatcaaaccaataattgtacgcatgatatgctacctttcttgaagctcttcacgttgattttagtatctaagttttcaaaacacggtttctagaaccaaactactttgagcgaatttgctaaaaccagtgaagcagccaatttcacatgcggcctcgatggtccaaaaagagctacggcttttgattcactaccactataaagtaatagaggcgtacatgaactccgccgagtttcatgtacgcctctaagcttattagttttcacatattcttaaatcgaatcaagtgtttctaaaaatgcaagatcaaaactattgagcgcattctgcataatttcttgtaaacttctcacacttaaatgcagacggtcactaattgcaaaccattctaacccttctatgtacttcaatataatcactttccattccatgtcaggcagtaaacttaaagcgtcaaccatatcctcaagatacattcgtgcttgaacttgtcgggtcatcttatcgactgttgtattttcgttgctgtgatgtgctggcattgcatctaaattcacactagacaatctaacgtgtgctagtagttgtagttttggtagatcatccgtaaagaatgcacgtactcgcttaaccgttaccttatcatcaatagataaagttgtacttaccatatactcacctcatctttttcacgcatgcaaattacatctatttattgtacaacgtgttcaacgtttataactcccccctcatacgaaaaattggctcgctatggaaaacgggactactgcatcggtactccttgactgtacccatggcccccctttattcatatcgtggagttttattaggttgttcaatcagccattatttcctgttttaaatccacaaccattacctccaaaaaaatcggtactacatcaattatagtaccgattcatattaaccctgctcttatgctagatttacggacagattttcttctgccttgtaaattaatagcataggagcattttttaattagtattgggtaaagataggtaaagataggaaaacaaaggcaataatagccggttacatttatttaaaaaagacttgataagaatggtttacaatagtaaacttatctcaaacatttacgtttacgcatgtagacaataaggagggaaaaagaatgagtacaatagtagttagccctcatatcaccgatgctgaatgggaagttatgcgtgtagtctgggcgaatggtcgagtgactagtaaagaaatcatctccatattgaaagaaaaaatggactggaaacaagccactatcaaaacgctcttaggtcgactggttgaaaaaggcgtactaaatacagagcaagaaggtagaaaatttatttatactaccaatattgaagagaaagaagccgtaggaaattatacagacgatattttcaaccgtatttgtcgaaagaatgtcgggaatgtagtagggagtgtcattgaagatcatgtcttaagcttcgatgatatccagcgactagaagaaatattagagatgaaaaaagctttcgcagtagaagaagtggattgtcagtgtacagaagggcaatgcgaatgccatttacatcatcatggagaataagtagcgaaaaaattggagaataaatcgtttgccatagaagatatgacctgtgcgtcttgtgcgcagacagtagaaaaagtggcaaaaaaagtgcgtgggggcacacaggcttccgtgaacctagcaacagaaaagttgagtatagaatacaatgaaccaactttttcggtagaaaatctacaaaaagcggtggataattcagggtatgaactgattgcccaagagggaaagacgcaaacctttgcaattgaaggggctgaatctgtagaggttgatttagcgactaaaaaagcagtacttgaaagtcaaacagagattgataccgaaacgctcaatgctgctttagcagaaactaactattcagtattaagtgcataaagtacgaataccatttattcatagatagtagatagagataaagtatagaacccttttcatgagaattatatgcagtgttagatgaggaagttctaaaaccttaaatccagtctctaatataataaggaggaattaaaaatgaggaataacaaacaacattcgtcgcatagtcatcataataacggcaatatggatcactcaaaacacgaccataatgaaatggatcacagcaagatgaatcatagtgcgatggatcacagtgaaatagatcatggcgcaatggaagggcatgcccaccaccatcacggcgacatggataactcaaaacacgaccataatgaaatgaaacatagtcagatggatcacagtgaaatggatcatggcgcaatgggagggcatgcccaccaccatcacggtagctttaaggatattttcttgaagtcactcccattaggaattgcaatcttactcattactcctttgatgggtattcagttgcctttccaaattatctttccttatgcagacgttgtagcagctgtattggcaacaattctatacatttttggcggaaaaccattcctcatgggtgcgaaagatgagtttaattcaaaagttccaggcatgatgtccttgattactttgggaataacggtttcttatgcctatagtgtttacgcagtggccgctcgatatgtgaccggagaacctgtcatggacttcttctttgagtttacaacgttaattttaatcatgttattaggacactggattgaaatgaaggcattgggtgaagcagggaacgcgcaaaaagcattggctgagttggtgccgaaagatgctcatgttgttttagaagacgattcgattgagactcgtccagttgctgacttgcaagtaggtgatttgattcgtgttcaagccggagaaaatgttccagcagatggaacgatccagcgtggcgaatcacgtgtaaacgaagcgcttgtgactggggaatcgaaaccaattgaaaaaaatcccggagatgaggtcatcggtggatcaaccaatggtgacggagtactctatgtggaaataaagcagacaggcgataagtccttcatttctcaggttcagacattaatcagtcaagctcaaagccaacattctcgagcagaaaatcttgcacaaaaagttgcaggatggctcttttatattgcggttattgcagctcttattgcccttgtcatatggatggttatagctgatgtaccaacggcagttatttttacagtcaccacattagttattgcttgtccgcatgccctgggtctggctattccattggtgactgctcgtagtaccagcttaggggccagtcggggattattagtgaaagaccgggatgctttggagttgactacaaacgcagatgttatggttttagataaaactggaactttaacaactggtgagtttaaagtattagatgttgaactctttaatgataaatatacgaaagatgaaatcgttgccttattgtcaggtatcgaaggtggatctagtcaccctatcgctcagtcaattattagttacgcagaacagcaagggatacgtccagtaagttttgattcgattgatgttatgtctggcgctggtgtagaaggtcaagctaacggacatcgttatcaattaatcagtcaaaaagcatatggacgtaatctggatatggatattccaaaaggagcaaccatcagtgtcttagtagaaaacgacgaagcaatcggtgctgtagctttaggagatgaattaaaaccgacaagtaaagacttaatacaagcccttaaaaagaacaaaattcagccgattatggcaacgggggacaatgaaaaagcggctcaaggagctgcagaaattttaggtattgattatctagctaatcaatctcctcaagacaaatatgaattagttgaaaaacttaaagcagaaggaaagaaagttatcatggtcggtgacggggtcaacgatgcaccttctcttgcattagcagacgttggtatagctattggtgctggaactcaagtagcattggattcagccgatatcatcttgacacagtcagaccctggcgacattgcatcctttatcgagttggctcagaagaccacacgtaagatgaaagaaaatcttgtttggggagcagggtataactttatcgcgatcccaatagctgcaggaatactagcaccaattggcataacattaagtccagcagtcgctgccgtcttgatgtcactttcgactgtaattgttgctatcaatgctatgacattgaaattagagccaaaataaacagttattttgcacatgaaataattgaataaccttatcgtttaaaaatacaatagtttcacaggaaaggaagagatgaaataatttaaaaaatcatctctccctttttgctcataagtcaataaattggactatttttattcagttccttaggcaacatttgagatacgattacgattataaaaattgatataccaaccaatggctgcttggaagactgacatattagcctcgatatcatcgaataactaaatacagaaaaatacaataaatattatcaaactaggaactatactagaaaacatcagtacattccttaactcagggtctataattatattatcgcccctatgaaagactattaaaacagcccccattatctaaccataagataacgagggttgtttttttgattttttatcataataaccccttaacattgctacatttttccataattttataattagacagttatatatgaattacgatgagatgcaacaactttccctactaattaaagactccgccacctttaaaaaccacgcagcttatttatggagattgcagccactaaagtgactttttcactttagtggctattttttgaaagcgttttctcttagtgctatgattaacctattaaatcattgataggaggaaatatatttataaaaatgtaactgttgcaggtggaggcatttcagatgagcaagttgcctttccaaggcatttcatgggattttatgaacatcctaaccctgaataccaacaagagtcattttaaaaatagagtacatcaatataaagcgtagtaagaggaggcaattatgcgatattctaacggaaattatgaagcttttgcacgtccaagaaagcccaaaaatgtggatcaaaaatcagcgtatattattggaggagggctggccggattggcgaccgctgttttcttggtgcgcgatggacaaatgtccggggaaaaaattcatatatatgaggaattacctactccgggtggatcgttagatggagaaaagcgcgccaatatcggctttgtgacacgtggtggtcgagaaatggaaaatcattttgagactatgtgggatatgtatcgatcaattccttctttagaaattgaagacgcctcttacttagatgaattttattggctagataaagatgatccaaattcatctaatactcgcctaatttataaccggggacaacgcgtcccaacggatggcctgtatactttggatgaaaaatctaaagaattaatagatttagttttaacccctgagtcaaaactgggtaagacgactattgaggaatttttctcaaatgagttctttgaaagtaatttttggatgtactgggcaactatgtttgcttttgaaaagtggcattctgcagttgagatgcgtcgatacacgatgcgatttattcatcatattgatggactacctgattttagcgccctaaagttcaataggtacaatcagtatgagtctatggttctaccaattataaagtatttagagtcatataatgtcgaattcatctataatacacaagttaataatgttctggtagattttgaaaatgacgaaaaaattgcaaaaaaactcgtgatccaggatggtgatgatgttagcctatcgcgtgatgatcttgtattcgttacaaatggttctattacagaaagttcaacatacggaagccatgataaacccgctcctgtatcaaaagagttgggtggtagttggtcactgtggaagaatctggcagaacaatctaatgatttcggtcatccagaagtattctatgataacctacccgaaaaaagttggtttgtgtcagcgacagccactataaaatcaccagaaattgaaccctacattgaacgtctaaccaatcgtgatttgcatgatcacaaaattaatactggtggaatcattaccataaccgattcgaactggttgatgagttttgctgttcacaggcagccacatttcaaagaacaaaaagaaaatgaaacaactgtatggatatatggactatattcagataccaaaggaaattttgttaataagaccatcgtagaaagttctggggaagaaattacgcaagaactcctttatcaccttggtgtccctgagtccaagatcaaacaattgtctaaccaaaacaatataaataccgttccagtatttatgccgtttattacatcatactttatgcctcgcgttgcgggtgataggccagatattgttcctaaagggtctgttaatttagcctttattggtaatttcgcagagtcacctagtaacgacaccgtgtttactaccgaatattcaattaggacagccatggaatctgtctatactttacttgaagtcgaacgcgctgttcctgaagtttatggctctatttatgatattcgagaactacttaaagccatctactatatgggagataaaaaaaccattgatgaggctaatttaggaattcctaaattagctaaagcagctctaaaaaagaagataaagggaacgtttatcgaagagctacttaccgagagtaaattactataaaacatggtagctgttaaaactctctgaattatcaaaaactgttgcaaattattataatgcgacatatttcgatatgtaataaacttttcgtttttgaaaaagacttgatgattatatttcatcaggtcttttttatagctacacccgtggtgctagttaattttttcctagaggaaaatgtctaaacatgttggtaaatcaacaaaaaacgcatatagtagtttcaaaactcccaagaaatgaggactatttaacaaactacgatggttacgtcgtgacaactgaacattttgacttagccaatcctgttactaaagtcgatgatatccccgatcattaaatgtacagtcaaacaatcgatagcttaaataagcgttttggaaatcgtgttttaaaagtcatcgaaatcggttacatcgcttctgaaaaggattggatcatcgactatttagccgataaagattacgatttaaaattactcagtgtgcatcataatggtcaatttgattatttagaggactaggtcaaagatatggatcctgctattgtgattcctcagtattttgcacaactttcagaagcagatgtctttgctcattttgactatgattttcgggtatttggtctatcccttgctgaatttaaacaatatgaagcgcagtttttaacgattctagatcaagtaatcaaaaataaattggcattcgaattaaatgctaagagcgcttacttgtatgacaatttagcgttatatgaatatgtcatcgatttatatctttcacgttgtggtaccttgtttagtgttggattagatgggtattaccttgaacatttccgtttccatttcgataatctttttgctctgttaaaagcaaaaggtgtgacggaattagcgatttatcaaaaaggaaagcgaattatggttccattaccagtctaaaaaacgtcctcagcatcaaaagtgaggacgtttttttagatttctttttctaaaatcggacaaatacgatcttgttttcctaaaggaaaatgtttgatcccgatttttttaaatccatgacgttcataaaaacgaatagctgcatgatttttttcataaacagtcaaacgtaaataacgtttttgtttcgttttagcataacgattcgcttcatcgagtaaccgttgccctaaccctttgttttgataatctttgagcagatagatccgctgaatctctatagcatctttttcatcattgactttcatataaccaatgagtatttgatgatccttaataccaataaatttactggttggctgtgccaattctactgacaatatttcagttgtcaattgtgtctgtaaatatacttgcatatcaagtggatctgcgccatcgataaacgattcataaaaactgacaacacttacaacttgtaaagcatctagatcatcataatctaaatactctagtgtgatttgattgttcatctaactctccctttttgacacagtatactataaatccggattttttaagaaataacctgattacgggaaaatgtatttgggaagtccggactgctttatttctaaatcataatccgagataatcaaatgtatgaattcttattatgaatgctaagctatgattaaatcaaataataatgagaaccagaaaggtaaaaatattatggtgcagcaaatcgtactcccaatcaaagactctaacgtcttaaaaatggtgcaagacaccttattagatagttttcgggcgggccgccgtaactacaccatctttcaagttggcaaagccaccctgctgcgggtgagtgatgtgatgacgttaaagaaatccgatgtctataatccagatggctctgttaaacacacggcctttattcatgataaaaagaccggtaaagcaaacacattatatctaaagcccgtgcaacaagacttgttgcaatatcatgattggctagtccaacagaatatcaattcggattggttatttccctcaaccgcccatccagatcgtcatatcactgagaaacagttttataagatcatggcacgcgttggtgatctattaggcatcaactatttaggcacacacaccatgcgtaaaacaggcgcttaccgcgtctatacgcagtcaaattacaacattggtttagttatgcacctattgaatcattctagtgaggcaatgacactgacttatcttgggttagatcaagcaagtcgcgaaacaatgttagatcaaattgattttgggtaataccgccaactaatctccttaaattagcccgtatttgctcattttgacgccaccatggaggtatttttaatgactaggattactaaggcacaattagatcgcatcattacagcgtcagataaacaaggccctgatacagctagtcatacttattctgcagacgcctttgatgcaaccatggataacaccggcgatactgacttgctgggttatctattactcgatcattattttggtgatgaatcatgacgaattttgatgagtatatgaccaatactaatttagccttacaagctattattcgctatgatgacagccgtgaaatccgtgtgtttaatgtaaaagataaacggtgctgtgtgtttattcaaaatgataatgaacatttctggttgctacgtgaacgtatcttagaaccgcccatgctacacaacatcacggaagcgatgtatcaagctggtatctatgataattattaccatctaagcgttgaagtatttcatggcgaggatagtaaagtttactatcctcggtgaaaattttatcttgtaaccatgccacattaggaggactattcatggaattagatttaggtaataacgcatatgatattttaaatgattggcatcctaatgcggctaaggaagaattaacggcacaactcacaaaacaagtgttagttgagaaagagcagctaccaaaacttttatcacgagaagatctaaaagaacgttgggagatgaactcacggcaaagcgtacatcaggttgcgaccagacccgatttcccagcaccaattttaacttttaatcatggtaaaacactcctgtacttagaaacggaaatacaaattttcgaagtcaatcatccgtggttaattacgatgagtgcccggttatcttatagccattggatcctgaataatgtgattaattgattgttggcgttagccttctgatacaaggaaaaaccaaggatgaaatccttggcaaactactattgacagttgtcaagagtgtaagtgcgcattgccctcatttcattcggttatgatccttgtaaacaatggcttgtacattgaacctttttaagacttaatgccattattttgtgagcgatggccatttaataaaatgattagtcattactgtttttagtcatccgattttcagaatagactagtaatttgattgttaattgatacgttaaacgcgaatatagataaaatgttcttggttagtaaggcattaactttaatctgtgcaaaaaaacacctataacgaataaaacgccatgaaaagctctttgtaagccttttatggcgttttattcgttatagacaatattttatatggatgattcttaattgcgctcaaaagctcttatacggcctgtaaattaatagcagaagagcattctttcttcttttattactcaaccacttcagaattaccttatctcttcctttattacctaagtaactcccgaagtcctccttattgtaagaatgccaaatcaactttttgaccacggtactcccagatacatatgtcaaaccacacacaatgccaaaataagccccgtagcatgttcctgaggagtgctacggggctatttgtgtaccaattatatgtcagatgtcattgacacccacgtcaacagcgtcccctctggtgggtgcgtgtatcacgcctatcatcgacctccgtgtcgacaccagcaatgctatggcacccgattatgggcacgtctgcgagtgatatgttgtccatcattggacactgaaaggtgctgtggcgtgcctctatggttggtcaacggtgggaacctaaccgaacgttatatttcacatttttgtaataatctgcggaaacacttagcactcctacacatagcgctgtcaaacactttatttcaacaatttaacaggttgtaatgactgcgtaacgatgccatactaaagcttgtcagtaattgtctgagggtacgttctgagccttaatcagcttggaggtgctcatatggagaatacactaaggattaccacgatgaactgggacatgattgtctctaacgttctatcaaatgcgaccatttatcttcttggtcgcctgatggataattggcttaaccgccgtaacaagtaaccttggtgcttcatgaggacataaaaaaagaccatgcttttaactttggacggttaagcagggtctctgtgtgtacatgaagtactaatgtcgaattttgtaagaatgtacctatcagaatagatctgacagagagttatgggaactgcaattcctgtggctcttttctttatgcccttattgtatcacaagttatatatataaacacgtctttacttattcatcgcgtcaacaacctgttcagttacatcaggatcatctgcgggcacgtcatcagtcaccagctcaggtaatggcaccagttgcttctcaagttcgtttaacttcttatcaccggtcacgatattactcctataccattttcaggtttacataaatcacagttatactaagtgccccaattaccaagggctgggataactttgcttagttatccaatttcacaaagtcagctcagtccatctaagacactgcacaagcgtcctctggggccaaatttcacaatctataccactcagtcctcataaagcttagggtgctctgtgccagcatgatcgtgtgattttatttttcccttggttagttccttgaatgttgcgactgataaaattacggatataatgaccgccccaactgggaccggcgtcactggattatagtagtagtcttttatgtcattccattgagtaataagaagcagccacgccacggtatatgctagaaatttcattatattctccttgttgtattgtctatttattagaaaatagtttcttacccgaacaatcgtgtaagccagccccttttaggctcattagcggttgtctgtgactccgtctctgtctcaatcatcttgatactggccaattcttcctcagctttagctaatttcttctctgtcatcagctggagttgctgtgattggctaaccagttgctgtgcttcacctaacttatcaagcaaaaaagtctcacgctcatcgtttcttttccgttccatatcgtatcgttctttttgagacgaaatctcagtcttgagactagcgataatatcagacatctccgagactttgatacgatacttttcaacgtcttccgaacccttttgcttcccagaattttgaagtggcttctttaatttctcgatctcatcgtccgagagacccgaagacaaatcagacaacgaaatatcatatttacgagctctgcgataagcagtggcacgacttatgccaagctccttgagaagtgcatcgacattatcaaatttattcataatctttcctccatgtatcagtattgtcaaccataagataccacattatcagtatcaaacaagggtatactgatacaacttaaacaaaacacgagacgatataaaaaagaataacagttcatttaaatgatgacaccgtatcatctcacagtattattcaagtttcgttgtatcgtcttaactgaatagagtctgttatgattgcacaaaaaaagacaccccagatggtgctctggaatgcctactcaaggattacactggttaagcaattaagtatatcgccataacattgatattgctatagtgaactgctgaaggctgtgttggattggctatcgcacgatgttaaccataaggattctggtaacgctatccaccaaacgcacgctgtacagagttcgatgatgtaaagacgattcagttagtatcacgcacgttaggtaacaaccggcacttggtgatcctcagccggcaggccttaatcaattgatttcatcaataaaaccattgaaaaaccaaaacaaatcagccactttgagcgcttgtcatgctccggagatatagttgtcccctgtgattgagaaataagttaaaaaataacttacttctgttaggacaactgcttgaatagccacttctcacgaagccacgaccatcgaaactcatctcgttgattcagtaccttactaccacagctctgacattcctctgtgttgccgtttccgactggttgtactgccttacatgcctctgccgtcaaatgcccttagagagcctctgacagccttttagccaccctgtctgttaccggtaagtaacttctgttttcaccgtatccttgtcggacttaggctttgccatttggcttggacgtatcaaagaccgcttcacgccccacaccccttagtgatggagattacaccacgcttgggcacctttttgaatcatcggggttggtgttccccgccatttctggataacctgataacggtagtctgcaccgttgccggatgattccataagtacaaaaaaggattccatacgttacgtgcctttcaatcaacacgcttgtacggaatcctcttggtaagtcctgactttttatgtcctgtttgtggagcttacctgttgattcaacctatgattattggtatactgagtatacgaaatcagggagttaaaaacgtgtcaaatgagtcgtgtcatctggcacagcttgtaagtggaattggcgttcctcctactcgcctttctgatatttaattgatgtgttaatcatatcaattaagcggtttcaagtcaagattgcctcgtgctatcaaggtttgggacagtaaacagtaattactactcccatagtaagactgaatatatttaagtcggttatgtgtcctccaaagacgataactggcttttttattgctctgaaatgcactgagaggtcaaagttgcaccgcttagtgggtaatccatcacagaaggctcttatatgacgccgtaatagtacaaaaaaaagaccctatggttaaccggattatttccatcccgccatagggtctttttatttattctgcaaaactagcttgcaaccaaactagttcctggtcaattttggggttcagttcacctggttataaatcaggtcggcctgttttatttctttaagatatctgcgacacgtttttgtagtgcgggcacgacgtccgtttcaaaccacggattcttggcaagccagatgttgttgagtggtgatgggtgcgccaacggcaaataccgtggcccaaaatccgcgaatcgatgtaccacactggttaacgattcactcgctttgattggcaaataatgctgttgcgcatattttccgactagcaaaatcaattcgatatccggcatcgtatcaagtagtcgttggtgccattcacccgccacaaatttgcgtggtggtaaatcacccctcttccccttgcctggaaaatagaaatccatcggtagcacaccaattaagccagagtcatagaaggttgtccggtcgatacccatccactcgcgtaatcgatcaccacttttatcattgaacaaaatcccggtttgctcaacaactgcgcccggtgcttggccaataatcaatattttcacggttggtgcaatcatataaatcggctcaagtccttgcgatgtaaatgacgcattacgtgaatcagccattatttcctgttttaaatccacaaccattacctccaaaaaaatcggtactacatcaattatagtaccgaaagaacgcccttggttgtgcatctcgacaagagattgcttaaattctggtgaatatcgaatcatataaaaaatgctcctctactattagtttacagggcagagaaaaatctgtccgtaaatctagcataagagcaccctttgttactgatgcccatgcattaccaaaccacttcgtaattccttcaaagaattgcttagcagacttcaccaagccgtctacgaattgtcggaacttcttattatgcttgtacagttcaaccaaagccacagcaatggccgtgattgccacgatcaacaatcctattgggttggctttcattgctaaattcatagccttttgagccaaagtttgagccttcatcgcagcggtcattacctttgacttagctgaagcaaccgtctgggccaagctaaagtcttttattttccgagtcaacgaagcaacatttttacctgcatcagatatgaagcttcccaaggccttagctttttcgacaccctttagtacagcaaaagtaccttttagggcaacattaagccccaagtacatctctgccaaaagcttaacgtctttagggtgctttgaagcaaaagctccgaacttttcaagaaacggtaaagcagtttttatggcgtcaccggtaagtttgaaacctgcaccgccaatgtttttgaccatctcaaaaaagttcttgatgtcctttgaatgtgtgctaacaaaattaccaagcttctcaatctggtcagccacgccattagcaatatcggcaacgggattctttgtgcccttgaaggtcttactgaacgcattggaaatggtgttgaccgctttattagctgagtcaccaacgtggtcaaaggccgtttctacttcctttccatcaagtgacttagacatgttcttcaaaaagtcgttattggattgaaaaaaaccgctcgttatcttacctgataagctcttgtatttctcttccaagtgattactgaagccatcgagagttgtgtagtaattatcgaacgcatagggcttggcatctgacatcgtctcaatagcctttgaaagatcatccatcgatagctttccatcagtagctaatttgttaatctcatctcggcttttacccatgctagttgctaacgcagcattaaatcctggcaaggacttttccatcttagtaagtgaaccggttgtgattttacctgaagcatttacctgtgaaaactttttaataataccttgcagagactcatcagattgccccgtagcacgtcccaagttaacgaatgcatcagacagggtctttgcaccatcggcacttttagtaagcccataagtctttttggtcaacaacgaaacggtatcggtagcatagcccgattcttctttcaatgccttaacgttgccaatcaaagccttgctcaacttgtcatcaccgttagtgaaattgtccattgatacagacaaggattgcatttctttgttgtattcaacaccagccttcatagcaccagtaaacttgcttttaatgtcgctcagtgtactagttattccagtggctacaatattccccataaggacacttttaaatcgtctgtgtgtacttgatagtacgtcattcaaatttttgagttgtgccttagtcgaagtaataccactaacatcaggctttatctcggtattatttaaggtctttattttgttagtggcttcagcaatcttagccccagtttgctcgactcgtaactcttgtagcttataggctttagaattcttatctcctgaagcacctaacttttcaagctcgttcttttgaatctctaaaatcttagtgtacttggattgcactgatgaaagaccatcaatttgagctttattagcttcctcagtcttgccttcagcttcgagtctttttacacgggcatttgttagatcatttgagcgtttaatttcatcattcagctctgctaatccacttttttggtaatcataatacttttgcgccttttcggtttgaacattcaacgacgcaagcttactctctgcctgtgttatctgtgaagcatacttttgataggtagcctcaccagcttcagttgaacgattaacttctgattgctcttgtcgcaacttctgaagcacgtctttttgcaattcaactgattgtgatagccctttatacttagcttcactggcgccaagtacatcaccagaagacttaagctgggactccatttgcttccactcgttggtggagtccttaacagctgacttcaattggctaagtgattccgcggccttattggtgttcaagccaatctctgtcgacattaaaccggctactttttcttttgccatgtgttacctcctttctttttatccaagtgactgatacaggttcatcatggcgtctgggttctgcattttgtcgtcttcagaagcgttcatgatttccatcaactcagcataatcagactcctcaatttcgtctaagctccagtgcagattctgcatggtatccttttcgaacattcttaaatcagccaaatgattcgtataggtcataacacattcaattggggttactctaaaccctcatcatcatcttcagattctgtcaaagccttctcaatttctgattctgacatgcccatcaaacgcatattcaagcgttgtgcaatagccataacatcttcttgggatagctcttcaagtgcctcaatctcagctggcttaagcttcaacatgtcgacaacgtattctgttaagttgtccagtgcgcccattacagcttgtagtgattcaacccgtgcgtcctcttgcatagaatcttccaacgtagccatcttcaattgaatggcatatgtcttctttaaattcttaactgaagccttaacttcaaagggtgccttacgcaattccttaaacgaaattttcatcatgtattcctttcttgggtacaaaaaaaggagttaacctgattattcaagttaacccccgttcatattgggcttctcaccccgtttgagcctatttatcgtcgtggctgtaggacaattggaacgaccttatacgccgctgggcgtggcagacgttgaaccgcctgttacaccaaacacatcagcttgcatggctgccttgtcgaacttagcgtcaatgtctgaataaaccttcatcgcctcgttgttccatgcttcaacaccaaatgaagtgaatgtcagttggtcatcaacacggacttcgttgttcgtatcagtttgtacgttggctacagtctcttgtacctcaccgttagcaaatccgaaccaaattgatttagtacgcttgatgttttgcgtctcaatcgtcaaagcaactcgtgggcggtcaccttgtaggaatccacccttaccatctgagatacgtcccaacaacttttgcttaatgtcgaatggtaggtcattaaagtccaacgcaactgatggctcacccttcgtttgtgtttggtcggttttagcgttgttaccatataccggcgtaccattagctgaaatgttagtaatgttagcgctctttgaaccaagcattgctgtggttacagggaaaagaccgtctgctgacaaccctgagtcacccttcaatagttctccagtttccttatcacgcaatgccaatgtgataagcttcaatcctgcaatagccataaaatgtaattcctttcaaaaaaatgagccaaccgttattggtcaagctcatcaagtgttagtgttttgtttacttcgatatttttaatcatctgttgcccatcggtttggctaatatccaaataccgtggctgactgtccgtgatacgccattccttggcttctaaggccttgtacatctttatctctttaccaataaggttctcttcgtcaagcccgtagaagacttgtaaacgatacccaaaggccatctcattgaacgtgttaccaccgtatgtcgtgatgtctgagttgctctcagtaatcagcacttgggtgacattctttttgtcgataacttcctcaggaatagcataaaagtatacttgccaatcagggaaaaccgaatgaaccacgttactaatttcttccactggtgtcattatttgttactcctatcgataatctgcttgtatacctctgcttgtgcttcaaccatcttagcttgcaattgggagtcgttacgtaggttatcgatggcatggtcaccgttaatagcaacctggccacccttcttatacttaagtccttttgctgtgtacatcggaaatttcgtaccattctcaatgaagttggcaatgtatgccttatcctttgaaaacccaactgttgatgagccatttttcatgccgtctacgttggtattctgcgcaataactgaatcagctaagtgtgggtctttacccgttgtacgatggcggtagtgattagccttatattcagcttcaagctccttagcaaacacatctgcgcctgccttagtaactttggccttatcctctaccgtcatgttggttgataatgcttcagcgtcttcaataaaggcattcaagattgattccaatgattcctcggccatacctatgccctccgtttcaatgtaacgaagtcatacgcaataatggcattagattcatcaggtgagtattgcacaatgtcatacatcacgccatcaatctgggctaccttaataccttccacatcggtgttatggcgtaccacgatgaccttagtattatcgagtgctgtaccttgaatttgatactgttggttcaacgtgcggagtttaggtgcacaccatacactgaattgttccacaaaaattttatgaatagaaccattattagcattctgtttagattccacagtaccaaacgcgaccttgcgattgaactcagctgctctcatgttgttcctcccattctgcatacttaccacgcaattggccaacaatagaattaaccgtagcatccataccaatggctctagtttctgtcatactgatgcggtacgtgtataacgtgccagcataggcatagacagcagtttcgtaacggtcaacaacagcaggttgagcatagaaattgtcatccgttccaattgcatcctggatgtaattttcagctgcagacaagtagccattgataattgcgtcatcatcagcaaaatcaacgcgcattagtgtcttgaattgttcaatattgaccgtcatttaactcacctgcctattaagcttgcgttccggctgcagcagcttgttgaacagtctttgcaggttggtcagcaatagccgtgaatgaaccagccacaaatgcatcggcatcagttgtcttaacatcaaagcgatcaataacacgtagcttcgtcaagtccttttcaaaggcaccgccaccgatgttagttgacaacaatgacatattttcacggtcaaacaacgttacagcttgcttcaagtcaccaaagtacaaaggcattgcacccttgtttgaaggcaaccacttgtcagcgatttcgattacttgcttaccctcaatcatgtagttttcaggttgagtaacatcacgttgcaacaagtaacgtccgtctgcgtccttaaccgttgccaaaacagcaataccagacgtgttagtcatgaagaatgacgttgcacggatagctgggtcaacagcagtcaacgccatcttcttgatgtcatcgaacgttgccaatgttggcttagttggtgctgcgttcatagcagcaatgatggcagtattacgtgtaacaacaaccttctttgcaatccatgatgacaaccatgccaagatgttttctgccgtatccttcaacaacgtgttagttaccgtcgtgatacctgcataacgcttaatcaaatacttgatggttgatagcttggggtcgtcgttgtcggcaattacaccatcttctgcatccaagttagtcaatggcgtgatgtctgaccacttctcaaatacacgtgaaccgttaggcgttccaaccttttcaacgttgacgtattgctccaatgaatcatattgacgcttcaacgtgttgatagccgtctcaatgtcttgtggaatcgtcaaaccaattgcgtttccattttcgtcagttgatgatgaaaccaagttgaccacctttgggtcattcttcatcattccaacaaagtccttaacaaacttgtccttgatattgacctcttcgtcgttcagtggcttcttgccagcgtctgggtcgttcaaaactgcatgtgcttggtcttcaacggcacgatcatagttgtccttcgccaagtcacgcttagcctttgcaacttcgatgtcgttcttaattgagttaatagcgtcaacgtctgctgcgtcgtcgttcaccaacaaagccgccttgttttgtaagtcagacaatcgttgcccagcttcaacccaggcgttgttcaatgtttgaatatccatatttttttacctcgtaaatttatttgtctagcaaaatagccaacttgcgggctttcaaatcgtccacaggctggctatcagtcttgttattcatttctttttgcttctcattagctatgatgttcatcagcttgctaatggctgacttaggtggcaatgcagcttccagtgaattagtcaccagtggcgcattttcatctacaaacaagatactgtctgcgaacccctgatcaactgcatcttgtgcattcagccatgtttcgttagacatcatttgcaacaaatcagcttgtgacttacctgtctttagttgataggcattcgcaattgacttatcagtgttgtttagcattgctgatgcactgtccatgtcatcagagttgccaccttgggtagttgatgccttgtgaatcatcagttgagcggttggagccatattcaccgtgtccccggccatcgcaattacagatgcagcactagctgctagtccttgcacattgaccgtgacgttgcctggatatgccttcaactctgaatagatttcactggccgcgaacacgtcaccaccaggtgatgaaatattcaccacaacatcatcaacttcaccatcattcaatacgtctgccactgacttaggacttgtatagtccatgccaaagtagtcataaaaccatgcgctatcgttatccatgacagcgcccttgacgttaattttcttcatcttccttttcacctcccttcaatactggctgaggcataattgcaaccggcatatcatcaggcaaatatccttggtttcgcaccagatattcaaattggttttggccaagtgcaccttgcttaacaatatttgccaacataccaagatagtcatcacccattgggtcaatagctggtcgcatgtctgccgtgatgttcgctgaaagcttagtgtttaactcaccaacaacggcactcacaaagcgattaagcgcgtttgcgtacagccctttgatttggtcaagtgacgattgttggtcgcctgtaccgttcaaataactatctggtacgccataaaccttggcaatttgggtcgaagtccaattgacctgtcccaaaagtgctgcaacattgcttttgatttctagcggcttaaactcttccaaatcatcaagcacaattggaccgccatttgaagcggtgtattgactcatgaactgcttggaacgtgatgccttggttttccagtcaagcaaaccgccacccttgatagacagcacaccgtttgcattaatcgactgcttcaacgcttgaattgtgagcttgtcgctctctctttttacgtttaattcgttgcttaatgccgtgagtggactgataccagtcaaaccaccgtttgtactcatcaatcgaacgtggataatgtcaccctgaccaaagaattgcgtaccaatcatcggttcatcgaatgacacttgatataacaacccgctaccgtcatcggtgatgtacggttgaacttgtgaaggccgtaattgttcccaacgttggtcttgtccgttaacattgcgccaacgatacgttcagccgtttcgttgtttgccttaattgccaacttgtagaattgtggttctgtgatgaaatcaccacgctttacaagttgtccagaagtggacaaccctagatactcgttaactcgtggccagcgaacgtaatttttgccacttttggcaaaagtagtaattcccatcccaattgctgcactttccgcatcgaacattacttgtccgtttacttccttaatcttcaatccgctaaatacttgtacttcgttctccatgattaaacctctacttcctgttgcttcaacttcacgtaatcgagagcttgttgccatctcttacggtccaattctgttgccgtcttaccttcgccagtaatcatcttggttaccaacgtagacatttgactacgagtgataccgatgaattcaccaacttgcgtttggttaacacgagccttagcaagttcaacgctccattcccacttatctgccatttataaacctccttcggtactaatttagttgaacaatgtttaaaaacattgttgacttagtactttttcagtactagaattacacttataaagaagcgttacaaaacgcctacttatccctatttatcagagcctgccagcatttgatttatcgggtttgtgtttttgtacgctgtttaacaacttggtacacgaattataatagtactgttttaataccgtgtcaactattttgatacgcttttagtacttttatttttcgaggccctttgaggtattgatatgacgctatttgaacgagttaaagacattgcaaaatcaaaaggatttgcccttactgaactagccagacgagcaggcataggtgaaaaatctatttatacatggaaaccaactaaacaatttccagatggaattgaaccaaaacgagaaacacttgaaaaagtcgctgacgtcttaggcgtatcagtagactacctattaggtaacactgatgagatgcacagtaataagaaggacgatatgcccgtggatcttgaagaagtcttagacaagttaggccctacccttcgctttgaaggtaaagaactaactgatgagcaaaagggttttgaaaatttttcggtgtagcggcaccttgcggtgtcgaaaaaacctgtccataatcttgacagcagcgccatcttaccggtatattcgtctcgaatctcgacctgttcttggaacattttctttcgttgctccgataaagttcgctttccactaccctcataatctttgcgtgaatattctttttcaaacctctgttgatgttcttcatccacaaaaacaccattctttgcattgtgtattgtgctaatattcccaccatctttaaaacgatgatttgttcctatgtgaaaaacgtctgcatctaacaatgtttgcaaatgataccttgcagcaacttcacttctgaattcatcagtcaagatagtccaaagaacgctctcacgttcttgtccttctcgccaatcattgaaatcaaaggaagcaaactctttaaggccatctattgacatcgtatccataattgagccaccttgtgatatatataattctttatttcttcaaataatcttcacttatagtactatcattccgaaaacaaatgttgtacgcgctatgttaaattttgcacaattccccaacgcaaaaaactcttgaatcagaaatgattcaagagtctatttttagatatcaatggtaactaatttacttatgattaattaatgcatcgtctgactaccggccaggctcaactcagtttgcaacggttgcacacccgtcaacgcgactgatcgtgaatctggttggctaacaccaactgagatttcaaagcggtcgctatcaataaagttacggccttgcgcatcaaacacttcaaagtcttgcggacgcaaatcaaacgtaattgtttgcttagcacccttacccaaatagacgcgcttgaagcccttcaattgggcatttggcaccgcaaattctgatcccaaatccttcacgtatacttgaacaacttcatctgtgtcaaaattacccgtattttgaatcgttgccgtcactgttgccgtatcttcatatgacttcacttgcaaatctgacaattcgactgatgagtacgtcaaaccataaccaaatggatacaatgcctcatccgtcatgtaacggtatgtgcgtcctgccatgttgtaatcttcaaacgctggcaaattatctacgttcttgtagaacgtaacaggcaactttcctgatggacttaccgcaccaaacaagacatccgcaacagccaaaccaccacgagcacctgggtaccaaatttgcataatggcgcgcaagttagggtggttctccaaaccatccaattgcaatgatgatcctgaagccaacagaacaaccactggcttaccaacagctagcaaacgctccaacaatggacgttgacgacctggcaatgacaagtttggcttatcaccagcgccctgtgagttaccagcatccccttcttcgccttcaatcgttgaatcaagtcccaagactgccacaacgacatctgagtgttcagctgcaataaccgcttctgactcacgttcatccgccttagccaacggctcggcagcgtggtcttggaacaatcctgacccaatgctgtagtgaactcgcacatcatcaccaagacgctcttgaataccctccaagatggtatatgaacgtgatggtgtaccgaagtagttacccaacaaagcgatttctgagtgcgcatttggcccaacaacggcaatcgcttccatcgtttccttgtgaagtggcaaaacgccatcattcttcaacaaaacaaatgacttctcagccgcaatttctgacaagttattgtgtgcctttgtatcgttcgcttcgtatggaatagcatcgtactcattatccgttgcaaacattcctaggcggacacgcgttgcataaagtgaaataactgcattggtaatttcttcttcagtcaccaagccacggtccaacgcttcatgcaaagattgctcgatgtgaccagcaaccaagttcaagccggccttgatggccaatcccatcgtttcagcggcatcctttgtatacttgtggttctcatgcacatcttctggcgccatgtaatctgagacgacgtgaccttcaaatgaccacttatcatgcaaaatttccttcaacaacatttcactaactgaagctggtacgccatcaactgcgttatacgccgtcatgatgctttcaacatcagcctcttcaaccgctgccttgaaagctggcaagtacgtctcgtacaagtccttgtccgatacgactgcatcaaagccgtgacgcaaaccttccggacctgagtgaacagcaaagtgctttgccgtcgcagccaacttcaaatactttgcttgtccttgcaaccccttgatgaatgccacaccaaactttgacgtcaagaatggatcttcaccatacgtttcgtgaccacgaccccaacgtgggtcacggaaaatgttcacgttaggagaccagaacgtcaatcccttgtagatgtcacgatcctcatgcttagtaaattcgttatactttgcacgtccttctgttccaatgacatcggcaatttcattaatcaagtgatcatcaaacgttgctgcaagtccaattgcttgtgggaaaaccgtcgccacaccagcacgcgctacaccgtgcaacgcttcattccagtagttgtattccggaatattcaaacggtcaatgcctggtgcttcatacttaatttggccaatcttttcatcgatcgtcatttggtcgacaatcaccttagcttggcggcgggcttcttcgtgcgtaagttgctgtgtcatatcaatactgctcctaaaacataattcatttcaatagataataattttgaaagcgctttctaacaccgttatttataccatgtgttatgtttttcgacaaaccgcctaaatgcttaccaaatatgaataggacgataaacaatatacaagcatcatacctgacacatacgttaatcgattttactttatttgacttgtgatacatttcacacattgtgaatgaactatgcacaaaaattgattaacataaccgtaatattgaaccaacaaaaaagacagcatcacgacctaaatcgtaatgctgtcttttaacagtctattaaactgatttcaaatcttagttaagtaataaattacttagcgataatatacaccgcctaaacttacaaatatcactcaaatatcgtgcataaaacgccttgttttggctatatatgtgcgatatatgcccgcaaattattggcgagtgaccaaagagtgaccaaagtgaccacaataaaaagcccgctagacgaggaagtcaatccaagtccagcgggcttaatttatacttgtaccaacttgcgcatctgtttatgtgtttttggtgagtgctacaaattgtgttacattttcaatttttgttgtgtattgtataattaattttaacttaacgatataaggagaaacttaaatgaataaattaactcattggacagaaagagtcctccaatttttggcatcagaaactgaagacgaccgtattttatatgtaggaaagttcaacgagctaatcgacaatggtttcactgaacgacaggcatatatcaatctgcaccgaaagattgtagagccattgctcgatgatgctgacctaacatgggaagaatataccgaagcaaccgctaaggctatgacgcgtccaaccttatatgatgtaaaggtctggattgagcttgctggcaagattggaccttctgcagctacaggtaactggcacgctgtagaacatgactgggaatgggacgttccaagtaaataacataaaaaagcccgcctagattaagtgcaattgcaccagacgggcttaattagttttcttaccctgtactagttgacaagttaataattggtaatttaaaaattaaaaaggacaatagtagtaaataccattgtcccgaaaggagtgaacgcgacgcagagtcacctgcgagaaacgtatagtttcagcgtcccttaatatgaaaattatattacactgtatgctaagtcactagactagtaggagttaccctaacaaacatacctgatactcgtatcatatacgataatggcgaaaatgtaaaccatttaatcactttatttctctaacacctaatttattggcaccatttgtttgaaaaccagaaaaccggtgtttcctaattgatgttttatatatagatggtttactttggcccacacttgaggcggccaacacgattggccttggtataaaatcagctatctgaagcaattgattattttcatacttgccaatgaacgtgatgcaatcaattctattttgtatatcaataccctcataaataagtgttccatgtgccaaaatttttgaatatacttttcttattcgttgatcttctatattattctttccagttttacgactttctaatataatttctccaactccatcatataaatttaaaaaagcaacaaaattctcaataatttgtgtgagcgctattttgtacgataagtagatgtttctttccataggaatgttatatgttcttgctaaagaggtttgatctacaacagcacctaatatgggaatgtcatattcatttataatatcgcttattcctctaattattttgtttttgttgccatctttatataatagagcactatattctggttgcttttcaatgattttggtgccattacttcgcacatcagcttcgtgtaagactactttcatatactctttccgctttgtccacactgtttgcttcacttttatcattttttcggatattgaatctaagtcagtatcaggaattataactccggccagtgcaaaaatatgccgttgggaattagaatcccaaaattttgtttcatctaagtacaaactatatttttctaccatcattaaatctttcctcttatatttcctatattatatacaataaaaagcccgccagacaaggaagttaatccaagtccagcgggcttaatttatatgtgggccaacttgcgaatctgtttcagtgtagaaagttggtccattttaaaactagttagcaaatgcagccttcaaccagaccgactcaccattcatctctacttcgatagatgatccaacacgttgcaataccgtgtacttaccattcaaagtgaagtattccggaactccgttgttgccaaggccgttttggtccgccaatgggttaccatgacggtcggtcaacgttactgatacagccggcatgtcgttgtgataatctgctactggaatagccatatcattgtttcgaacgtacacactacccagctcatattgccagctatctagatagaatacaccgttaaactctgccgagtcatcttgcgtgttggcatccaagatttcgacgttcttctttgatacccaagaatagatgtcatcaagcaacacacggtcgccatcaacttctaacaccttgtgtggctcacccttgacatagttaggaatagcttcaccagttgcgtaatgagtagcactgaagtttactttaaccgtcataccaggtgcgatgtctgcctttggtgtattatcagcttccttaccggcaacaattgcgggtgtatcagtgttaggcttttcagggtttccgtgcttgtaaccattgtccgtgataccagtcaggtcaacattaccatccaatccaccagcaatgtatgatgccgtgaattggaacaattgtacattatcaaatgaaggaaagtaattatagtttggctctggcgtaacctcgtaattaggatactgagccaaccaaagcgggtacttattagcaatcgcttgtaggtcaaggtttgacatcaagaaattcttgtatccgtatagcacagctgtctttccctttgattgaatataatcaagtccgtacataactacgtctgtattcgttgcaccttgctcaatatccaaagcaaagatagctccctttggcgtttggctttttgctagatagtgatcaattacagttttcatggttgcacggtcagtaacaccgtctacgaaaatatagtcatgtgcgcgttttccttgggcgattgcatactgaacttgtgttggatacgtgtattgatcaacgtagccatgtccagcgtagtacccaccaatttgcgcgatagcaaacttatcgtgaccatatccaaacttaccttgcgaaccttggtagattgaccaatcaacaccctggtcgcctttggcagcatgtactgatggtactgatcccataattaaaagcgccccagccgaagccaaagcgctttttagcaatttattcatatgattattcctccgttattgattctgaagatgttgtcgtttcctgatttgaagctgagcttgctaccgtagctgctgagcttactggagcttctgtcgctgaacttgttggtagctcttcaggaacttcaatgattgggtctggcacatagatttctgcgtcagccaccatgttcttaatcttagccaagccaaggcgctcccagtccttcgtgttgtcagtcaacttgattccatctgattgtcctagcgtcatctgaccacccaggtattggctagaatcttctgagttacggattgaataaggcaagattacctgtgatagttgaataccattaccactgttacttacctgaatttgtggtgtgtcaaaacttactgatactgtcatttatttttgtcctttcatctctttaacagcccattcgattgcttcattaatctgcttagcagtgaacagatgagccttgtcagctttcataagataatctgtaatcatcttgatggcttgtgctttttgcgtttggccaccatcgaaggtcacctgagcccaattcactgcatgttctgaaatatctaacaaggctgtgagcctcttattgcgggcaaatcgtgctgatagccaaccaatgcctaaaattaaaagcgctggtaagagtccactctcccacaacgcttctacaagggttattaagttattcattgtcatcgtgatgttctctccaatcttcgattatagatatacgcttctcgtggtcatcaatgcgtgaatcatagccttccaaagtgtcctgcaaaacggcaattgtcttattcaagctgtcgattgatttaacaaaggtcatctttatcacgaaccacattgcaccacttagagttgccagaactgtgagccagcccgctaagtcgtgtggaaaaaatcccatatcatacgcctttcttttatcacttaaagtagctgacagagccctcaacgtataaaacaatacctttgtagtctgtggtgttattctcaacaccgtggcgcaattgatactgaatctgccctgtgttagtaatgtggaccataagaagttgatctgtttgagtagaaaccccaccaatcccactacgaccgcccataaccgccgttacgtagctgaaaggttttgttatgttgctaggcatttgacccaagttgtgccatgaatacgacgcatcacctgtgaaggtaccagtaaaccaaacctctacgccggttgcaaactctcggaagtccattcttaacccgtttgcagtaacagagccggtcttgatacttgatgttttaacattagccaacgttgtgttacctgtgagtgacttatcacccgcaaggacttcatttccagagttatgcacaacaccgtcatcgtccgccaagttgtgccaattctttccgtcccttgattgttggatagaagttccgtctgacttgaagttaggcgtgctgattgtctttgccgtaaccccgccgttagacgttacattggttgctgtaacacccttgtcgaacgtagctgtttcagtgaagtgattttcaacgttcagcatagacacttgcttggaatcaatttgccctgccagattctcaactgacgttttcaaagtttcataagcaagttgttgcgtctttaggttgtcattcaaaccactgatacgtgagtttgcttcattaacagcctgttgtactgaatcgatgtagtcctttgaagcgttagctgtgaacaaaatattgttagccaacaccgtgaacgttactgggattgagctgataaccgtaccagcgccgtcttgaacactgatgtaagcctcttcaatgtcaccagctgattggtacatctctcctgggattagcattgaaaacaaacctccagtggctgaaatcatgtcgtgaaccccagagatttgcttaaccttacctgctgaatcctttgccgtaagaacaacgttttgaccatctaagttgtgtggcaagttgccatctttgatagcaaagtaaacgatccgtccgttatcaccttgtcgtcctgatagcgagtcaatcaacgtcacatcagttgtgtctagcaacgtgttaactacggcatagcgaccctgtgattgtgcttgtgtagccatattttcttaattcctcaagagaagcggttcgagagttttttgatagtgagtggccacgtatcgtgaacatggctgatatgggatatgttgatctgaagtcagttgaaatttcagacatgccaagtgcgcgatcatttggaaatgccaacgatgagaggttcatgaaccacactgacgctgtgtactactacgatgccgtggtccatgccattaaagtcatgacacagccacacaggcacttcatgtggttgcgatacgtccgacacttagaatggttacaagtagaagcactgactggttacagcactagacgtggtcaagagattatcgatgaagcgtttctgttgttcgctgataatttttctgacgttgatgatctgcgagttaaggaaagcagcagttattagttgcgcaacttattaattatttattgactatttaaccaagtggatatactatttgtgtgtaacatattatagataacctgaggggggtacgatcatggctttagaagacaagattgatggcgcaaaggatcaagtagcaggtaaggcgaaggaagttgaaggtaaggttactggagatgaaactcgtgaggtagaaggtaaggtccaaggactattgggtaaggccaaggatgcctttggagatgttaaggatgctgcagaagatgtagttgaagacatcaaggaaaagtttgataagtaatttttaatacttccgaatgcgtactcgctgtatttggaagtattcttttgttcctttagctcagttggttagagcagacggctcataaccgtccggtcactggttcgagaccagtagggaacatggcatggattgatagatctcaggccttttcatccctatatggccacaacactcacccagatgtctatcaatctttgcttttataagccgatatggcggaactggcatacgcagcggacttaaaatccgtcccttaattggttgtgggttcgaatcccactatcggcatattcacatcaggtagcaatcagttagattgttacctttttattttattttgactaattttacgaagaaaaagcgcgtatatggttcataagtgccgcgtgcagggtgcaggcagtccaagttattatgatagagtaccaaagttgaaataaagcatgtgtggcggaataggtagacgcttagttgtgctagagagcaacaagataaggcgcttgatgggacgtagccacatctcaagatgccctgtgctaatcatgtcaggtgcaaatcctgaccacatgtatagtgagatgtagttcatcgtatgtgcataaaactgacaacatggttgccaggatatgccataacatctgtatggctatcttgcgaaagttcatgtcagcgcccagcgttgcctggcatacatatcaataaagcataaggatatgctttctaattttgttgttcgtgccgtggctccggatatgtgagtgtgcggcttttgttttggagttgtgaaaacgggggttatcatattgtccaggacatagtacataaaaattgttatttaagtcagaaatgtaagtagtacgattgttaattagatcgtggagtcataagagtacttgtttttgactaccattgactagttatctttattatcatataaactaaattagttaaataatgataaaggtaatagtgggtatggatttagatcaagtaataaatgtgattgaagatgcagatgtagaaatggaccttttcttcacggaaaaaagcattcatggatatagttctttccaagctgatataaatactgatgcaagggggcgacaggtcattgaaaatattaagaatctggtttctgggacaattcagcgtattaatacagaacattttaatacggtacagtataatccaactggcgttgtagatggaacgttagaagtgatcaatcatgattatgttgaaagctataatgaaattatggatagttacaatgatattgaaacggaaaatcttgaggaaaatgccgataacttaacattttatacactgtttttccgtgtcagagatcaagaagtaaaaattatgagacgggtctctaagtttaaaagactcagttctaaaggtgttattgcaactttcacggggaatgctattaattctatcgatagtaaaatgatcggtattgatggcgcagttgatctaatagactataatgatgaaatattggttattaatcatatttctattgagcgtatttttaatatggataacaagttttcagagactgcaaccaccatgttgcaacaactaagcaacaacaacaaaataggtaattttaatacattcgaggaagattgtttgaatgataaacgcatccaaaagactcttacaaaaatggcaagtgaagaaattgattgggaacactgtttggatagatttgaaaacgttgtaaatattattgatacttttgatttggatattgattatcagcgagcacctcaagagcaggttaattatgaaaataaaggccaactgatggattttgttagattaattcgtgatgcatattacaagacaatgattaatgaacaaataggcgtcgataatggtatttaaataaatgtgcacaaagggggcttgacgtggtgaaaaataaaaaagaaaaaatattcaaagtttctatgtttatatcgtcatatatgccattgtatatttttattttaattgctaaatttgacaatgtgtctagtagttttcaatgttataaaggtggattaaaagttaccaattggtttgagttatttttagatcttgccttagttattttaatattattgtcgattgttgttgtaaagattttaacaagcacaaaagcaacagcacataatattgttgctaagcatattgagccaacgagagatactacgattagctatatagccacttatatcgtgcctatgacaagccttgttaattcaggattgacaatgaatgtcctttttgcaaacgctggattgtttatactaattggtattttgtacgttaaattgaatttagtgtatttaaatccgttgatggtattactggggtatgtcccgtattttgcagggcagcaaattattatatcgaatattgaatatcgaaaactgaaagactttagtcaaaatcggtggaatggaacccatatcagttctcggattatcttattaagaaaacaggataacagctagtataaaaacgcaggtagtaattgtttaaattactaccttttattttgcactgaaaaggagtaataacatgcacaagaacttaatgggcaagttgattaagagtaacaatatcaatcgtggggaatacacgtacatttatggcgctaatgaattagttgatatagttactaacggtggtaagcaatattcacgcaacacggcgtttgatggtcgattcgatgagaatgcatagatgtgcagagattggttgccgtgagctgattaaaccaggttggacttattgccagccacattatgaagcacgcatgaagaagtatgtacatgctaagcaggcaacgcggcatattactaattaaggaaggagttaggtacatggctaagatgacacgatgcagatacgtcagccctgccggtgtaagatgccacaggttggcagagacaccaaaccattactgcgaaatgcatatcgaacatgaggcagagtaccaagccaagcgtaaggaatggaacgtcaagcatacgtcacagtactaccacaagtacaacaagacgcaacgtttacgcaatgatacaaagcgggaacaagataagttctatcggaataagcagtggaagaatggactaagacaagcagtgctagagcgtgacaactacctgtgccaatactgtgtagctaatagacggatgacaccaggcaagatagtagaccacatcattccctatgagttcgatccaagcaagcgtgatgacctaaataacctggcaaccatctgtgctgcatgccacactggcaagacgcgttgggagcaggagtattacggtacaggagcagggaacgaattaaagaacgtagcagcagtgcctgacattaaatacttaccagattttatggatagcgctagaacgcaatgagcgccgttttaagcgctttttgttttgtccggcataactaatcgattgtgttcttaaaattaaatgaccccgcccctgggtgccttaaaagaaaagcacacacattactgtgttcttgtagaaaagtttgattttgaaaaatttttaataggggggtacccagcaattaaggaggtgatgttaggtgccacgaaaaagctatgaaagcgagtctgacgcggttttgtcgctgacaccgccacatcacttaggcaagattgcaagtgctatgtggcgtaaaatggtgcccgtacttaacgcttcaaacaagatggctccattggataagaatttggttgaaatgtacgcaagtcaatacgagatttatcgaaatgcctatgaagatatcaaagagaatggccaagttaccaaagtttataagacggtggtcaacccagtaaccggagatgtgattgctaacgatatgacgggctataagcgcaacccaagcacacagatttactcggatgccattaagcagttgaaatcattaggtagtgagcttggtttatcgcctgccagccgtgctgaacttatgcaattgagtttggacgacggaaaagacaagccaagtgctacggaacaactgcaagcgctattgaatggaggtggtgatgatgagagttgatctaactcaatcacacgacgttctaggttggtaccagcaactacatggcgattacgcagatatcagaaccaaatacaaggacgctggaacaaagtacgcattcagtgtcctagatggtgatgttctggccggctacatgattaaacttgcagcgttccggcatattcaagacttggtgcgttcagaaacagatgattcgttcgactaccattacaacgtcagggaagccaaaaagatacttcaatttgcgagtgtatttcctgatgttgataccggtgagccaatgccacttatgccgtgggaaaagtttgcgctaactcaattggttgggtggcgtgaccaccttggtaacaaacgatatacaacggctattctgtcagttgcgcgcggacagggtaaaacttatctaatggctattcttatggcctatgacttcatgattgagtcaattggattgtctaaccaagactatctagttgcatctatcaattggaaacaaactagtaaattgttcgggtacattggaacagcacttaataagatgacgatggttgacccatggaaatcgttggctactgaatcaggattgaaagttcaaaatgaccagattgttatgaagaatttcaacaatgggcgctgctgtcaagattatggacaggttttttcgacaccgcaaggtgccgctacaccgaaaaattttcaaaacccaatcatataaacgccttagcgatttatcaccgcctcaacgaatatatactatacagaacatttatatagatgtcaacactatttgttgaactttgtttttccatgagtccaagtagttgtccgccgtccattcttgcaggcgacgacggttgtaaccaacactggtgttatagtatgtcacaccgtttcgctcacgaggaggaacggtcacgtgaatgtgtccgtagaaaacgtgcttcacattatcatacgattccaataattcaccagttcgtggtgaaccaagcacaccgttgaccatgcgccaacgacgatcgccttctggataaattaattcgtcaccgattggggcgaagtgcgtcatgaagatgacttgcttattggccgctttcgcatcatctaacaggaccttcatttgttgcaaccccaaatccatgcgttctgggtcggacattggttgttcgatgatgcggtcataatagaagccacgccggaaggttgccacttcctcagggtcgataccttcagcaaacaaataatcgtaccaaccgttgtgaccaataatgcgccaatccgtgccaggaatatcgatgtacttattatgtagataatgttcattaaccggtgattcaagctcttcaaatgatgtgccacggcccatgtcgtggttgccagcgatgaataaaacattggttgatccaacgttttgttgtaaatcgctcacatatgtcattgatttcttaaaatcgttgaataagtcaccggtaattaagtagaaatctgggtttatttcgttaatatattgtgattgttgtgcaagaatttcttgataatcttgcttattgatgtcgaagtgattatcacttgtgactgctatcttgaccatgataatgcctttctgacgccgttatgacagtaattgtaccaaattcgcaacgtttattgttggaaaaagtaaattgtaattctttgaacatcttgtgataatgaagaaattccggtaaacttaataagtattttctaatgaataagttatttttagtactctaaaaaccaaatatataatttgtaaggagcttttctcaatggaatcagaaaagaaattcctgggacaaccacgcggtctacaaactttgtttatgaccgaaatgtgggagcgtttcagttactatggtatgaaggccattttgctttactacatgtggcacttgattgccactggcgaccttaatgttaccaaggcaactgccgcatcaatcatggccatctacgcctcaatggtttacttgtcaggtgttgttggtggatttatcgctgaccgtttgatgggtcaacgtcgcactgtcttctggggtggtgtgttgatcatgttcggacacattgcgttggcgttgccattcggtgcaccagcgatgttcgcctcaatggtcttgatcgtaatgggaactggtttgctgaagccaaacgtttcatcattggttggatcactttataaggacggcgattcagcgcgagacgctggattctcaatcttcgtcttcggtatcaacttgggttcatttattgctccattgttggttggttggacgcaagagcaagccggcttccacttggcattctcattggctgccatcggaatgttcttcggtttgattcaattccactttggcggtaagcacttgtcaaaggattcattgtacgcaccagatccattgcaaccagaggaagttaagcctttggtaacgaagattgttttgggtgttgtcgcctttgccttggttatcgtgttgatggttttgatgggctggacgcaattgcaaaacttcgttaacttgttgacgattgtcgcaatcttgttgccaatcggatacttcacgttgatgattacgtcagctaaggttaacaaggaagagcgttcacgcgttatctcatacattccattgttcttggctgctgtattgttctgggctattgaagagcaaggatcaatcgttttggcaacgttcgccgcagaacgtgttgatacgtcatggttcccagcttcatggttccaatcattgaacccattgttcatcatgctttacacgccattctttgcttggttgtgggttaagtggacaaagaaccaaccttcatcaccaatgaagttcgcaatcggtttgatgttcgccggagcatcattcttgttgatggctttgcctggaacgttgtttggaacggccggtaaggtttcaccactttggttggttggctcatgggccttggttatcatcggtgaaatgttgatttctccagttggattgtcagttacgactaagttggcacctaaggcatttatgtcacaaatgatgtcaatgtggttcttggcttcatcagctggttcagcattgaacgcccaattggtaacgttgtacaaccctaagaacgaagttgcttactttgcttggttcggaatcgcttcagttgttcttggtatcgttttggtattcttagtaccacgtatcaagaagttgatggcgggtgttaaatagttaattagaagacgcctaactcattatgagttaggcgtcttttcttgttggaaaagtaagtaaatgagtctataatcagttcttgtcgaaaaaataggaacggtgaataaaatgacagaagaaaagtcatacaagaagtggctcgcgctggcagccatgtctttgggtgtcttcatggcccttttggacgtgacggttgtgaacgtggcgttgccaacgatggcgattgatttcaagacgacatttaataacttgcaatgggtcttgaacgcttacacgattgtgttcgcggtaatgttgttgattgtctcaaagctaggtgacatgtttggtcgtaagaagattttcattgccagcatgtttgttttcgtaattgcgtcagcgattaacggaatggcgtcatcattgttggtcttggatatcggtcgaggtgtccaagccatcggaggatctggtttgatgtcattggcgatggccttggttgcatcaaactttgaaggtcgcgaacgtggtacagccttgggaattctagggtctgttattgagctttcaacggcttctggaccgcttgttggtggttggctagttgaagcctttggttggcctttaatcttctatatcaacgtcccagtgttattatgacttggattaacgtcaaggagacgccaagttacggtaagggtcaatcaatcgacttcttgggaatgttgttgtctgcagcagctttgttctcagcagtttatggtttgatccaaaaggaaaccaatgtccactgggcatggactgatatgcgtatcgccggctggttgattgccggatttgtattggctgttatcttcgtcttggttgaattgaaggttaagacgccgatgatgaacttgaagatgttcaagagcattaactttgtgggtgccgttattgtggccttcacattgggagctggtgtttatgccatcaacgcttacttgacgggcttgatgcaaaactacatgggctacacagccttccaaactggtttgcgccaattggttatctcaatctggtcactggttttgggaccggttacgggtattttgggtaacaagtactcaaagaagtggatgatgtcaggtgctttgttgcttggcggaattggtttcttgttgttggcaaatgccatgacgacgaagcttgaattcatcgacttggtaccagcgatgattttgatgggtattacgaatgccatcgttaacccaatgttgaatacggctggtcttgaaggtgttgcgccacaagaaatgggaatggcagctggtttgttgaatgtcttccgtcaattcggtgtgtcattcggtgttgtcatgcttggtttgacgcaaacgaaccactatgaaaagtacttgaatgcgcacttggattcagtgaagatgcctgaagctgctgcaactggtttgcacaaggcattggttgaagctggaccattctcaggtcacgcggtggcgtttagtgatcgtctatcacaagcgccatttgcacacgcattccaacaagttgtgttgaacgcgtacgataagggaatggcagctgtcggtgtgacggctgcgattacggtcttcatcggtgcaatcggtgcagctgtgttcatgcgtgaacgtaagcaacaataataaattttgaggcacgcctatgcgcgtgcctttttatttggatgaaaaatcccaccagaaaaccattgtcgtcagtcctaacattgagggtgtaaaacgtactgaaaggaatattggatatgacaaaaacatttaaaacattggatgattttttgggcacccactttatttatacttatgacaatggttgggaatacgaatggtacgctaaaaatgatcacactgttgattaccgtatccacggtggcatggttgctggacgttgggtgaaggatcaagaagcagatattgtgatgcttactgaaggtgtatacaaaattacatggacggaaccgacagggacagatgtggcattggatttcatgccgaacgaaaataagttgcacgggacgattttctttccaaagtgggttgaagaacatcctgaaatcacggtgaccttccaaaatgaacacattgacgtgatggaagaggcacgcgagaagtacgctacttatccaaagttggttgtgcctgaatttgcatcgattacctatgttggggatgcgggattggacaatgaagatgtcatctcgcaagcgccatataatggtatgcctgatgatatccgacagggtcgatatttcgacgaaaattatcagcgaaagaaccgataatatatgttgcaacaactaaataccaattaatttcaaaaaaggggttgccaaggtgtgaaatacttggtattatataaaagttgttgctgggttttgaaaatttttcggtgtagcggcaccttgcggtgtcgaaaaaacctgtccataatcttgacagcagcgccgggttacaactcattcagtcgtagcttcagtaagggctggaattcatttactgatggcattggcagagcttggaactcaacatggagttacgttgggaacgtatttgataagtacatcaatatgtacaagcgtattattaggacgtttactgatttctttacaggaaactggggaaatcttggtaaagacattcgaggtatctggaatgcactgtgggactatgtagagtcaatctttggtaagaaggctggctctatcaagcatggcattgagaacttcggtagctcagtatggaacttgtttgggcgtattaaggacaaggtatcaggattttggtctgacatgtggaacggcttgaaggactttgctcgtgatggtatcaataacgttatcagtgtcatcaacaatggtatcggtggtatcaacacagttatccatacgtttggtggtaagaaggaagccatcggtaagattccaaagtttgcaaatggtaccaagggtgcgcctaagggcttggcaatcgttaatgacgccccaggtgagcattatcaggaagcaatcatcgataactctggacgtgctacggtacttgaaggacgtaatcgtctggttaacttctctggtggtgaaacggttatcccagcccatgcacttcctaagtttgccaagggtactgataactggttagacacagcagttggctggatcaaggacaagtgggaaaagctgacggagttcatctcacacccaattaagtcattgggtaacatcatgaacaaaacagttgaaaacatttcaggttcagcgcttgtaactaacgtcgcaccagcagtaggtaacggatttgtgcaaggcattgcagacccaatcgtaaacttattcaagtctttgaaaaagaagcatgatgacgaggaagcatctgctccggctgggtctggtgtacagcgttggaaggacttggttattaaggcgcttgataagaatggtttgtcaacgtctgaatctatggtgaacaaggttctccgccaaattcagaccgagtcaggtggtaacgaaaaggcagtccaaggcggctacactgacatcaacacgattactggtgatctcgctaagggtcttatgcaaactatctcagcaacctttaatgcctatgccttcccagggcataagaacattttcaatggttacgataatttgctggctgctttggcttatgccaagaaccgttatgggtcaaacttagcgggacttggtgaaggttatggttatgctcagggtggcattgtctctcaacacggtttctatgaagtcgcagagcagaacatgcctgagattatcattccacttgacccagctaagaagatgcgcgctaacaaattacttgcagaagctaaccaacgtatcaacggggcacaatcacagcaggttgtggttcagtctgatacatcacagttggagcaaaagttcgacaacgtaattgcactgttgtcactcatgcttggcgttaatcaggaccagctcaaggcactacaatcacaaggcggtattaacttaccaaacctgatgaaccagatgggcatggctcaaacaacgcacaattatcaatcaatataacgaaaggatattcccgttatgaaactattcgtacagccctatggtggcgaagaatatgacttgacggccaggcttccatctgtgaagtttctggatatgaagtcatcagcacctcaattaacaggtgactggctaaccatagccggctcagatggccaacggttacagaatgccacttatggatccaatcaagtcaccgtgtcattgtttattaaggggcgcaacatggctgatttcaggttgcttaaggcagagttgaaccgtgtcttttaccagcgtggcctaatgcgccttagaagcacgctggaaccatttaagacgttttgggtaatggctaacccaactgatatcacaccgattcaagcttcatcacaagggacggtagaccttatgttcaccaatccaagtggactggcacagagtttggtcaggtcagataagttacctgatgacttaagcagtttgggctttggtatgaatctaccagccaagccgttgagctatgttggtaccagtaatcagttcaacatttacaacccttcagatgtggccattgacccatacgttaaccatcacgacttggtgattacagttaagggttctggtgcgtttactttgacaaatcagacaaatggcaccagtatcacgctgaacaaggcgatggctaacggtgacacgttcgtattgaatggtgtaataccaacactgaatgggtcaactgacgtagacacagactttgggcacatcgagttggaacgtggagataatgacattcgtttaagtggactaagcagtgccaatattaccttcagcttcccattcttgtacttctaaatggattacagcaaagataaggttgttattcaatcgagggacggcaagtccacacaagcgttatcctcactgaatttcagcacgtttcagctcacccgtacgaagaatgaagcttaccaagttgatttccaagcgtatgacgatggatcacttgggtttgccttgttacaagtggagaatctggtgcaatatgacggtcaaacctacgtgattaaacaggcgactgatgacaacactggtggtgttcacaacgtaacagttacggcaacacacattttttaccagctcaacaatcggttccagtacaacgttagacagggtgataattcgttcagtttgactgacgccttaaactttctactcacagatattggcgatggctactcatatcagattcatggtaagtttgatagcaacaagacgctaacggattttggtaacacgtcaatcatcgaggggttgtcgacaatcaagagtgcattcggtgtatatgccatcgtacctgataacaaggtcattcacttgcacgacaaagattcatatgtgaccaatacccgcaaggtatttaggtatcgtaatgatactgccgcagtacaactacagtatgacgcaaccagcattgtgaataccgtgcaagctgtatcaaccatggaacaaccagcattctcacccttcaaggtacaggacgcagattcagttgctaagtggggtatcaaagagggtgcccgtgttgaaagtgattcagtcaccagtacggacgccatgaagagtttggcttcccagtcgtttgtattggagccctcgttggctatgacagttacatcagctgggaatgaagacgttgctttgggtgaaaattggacagtacagatgattgataacgggtttcagacttctgttgaagtggtcagcattgtaagagcaccgtttgctacatcagcggtacagattactttgaacaacacccgcaagaattatctggacgcccaaagggtacaacaatcagcaatcgacatggcaaaaaagaacacagggacaacaggtaacatgtgggttatcggaaaggtggaatcatgacgttaaatggaatcgacatatcaaactggcaggctggtatcaacctaagtgctgtccctgctgatttcgtcattattaaagccaccgaaggaaccacctatgtgtcgccagaggctgatacccagtaccaaggcgctaagtcagcaggccggttgttaggcgtgtaccactttgcaacaggtgtcggtgctgtggaagaggccaagtttttccttagcaacgttcagggctaccttggagaagctgtcctgttcctagactgggaaggtgctgttgtaacgcaaggtgttggttacgctaagacctttctggattacgtgtatcagcagactggtatcaggccattgatttacatgagcaagtcagtcacaaacagttacgactggtcaactgtgagttcggattacggtctttgggtcgcccaatacgctaatgcattgcccactgggtaccaagatgacccttggacggatactaatggttatggctcatggggtgggccagcaatattccaatacgcttcaacggggcgcctaagcggctacgatggcaatctggatttggacaagttttatggcgacaccgaagcatggcaagcctatgctaagtcagaccggattgagccagatccaggccctaacccagaaccggagccacctaagagcacaccaatcgtgcaatatgctgaccctgatggaaataaggcttatgcctacacccattggcaagctatcgcaggcaagcctgacttgagcacagtggtattgaccagccccaatggtacgaggtatcaactggtggttgatgataaggggacactgacaacaaaggtggtgaagtaaatgatattggatttacctaagcgtatttctggagctgatgatacagcacaacagatttaccaagcattttatgatgttggcatgattacagatatgcctatgccaatgaagacgctgaacatttcagaatacaacgagcaagcattctcaaatattgggagtgctttaattttgctcaaaaacaacctcaatcgactggtggacatcttcaatgagtatcattttgtcgatttgattgctacctagtgtgatccgaaaacactgcattgttcgttcggtaaatgttgaatccgtcaaaaataccgaaagtggacaataaacaaacattaacagttaattttgagtgtaaattaagccattctgagagagagagaattttacccggattattcatgcactaaatttttaaccacagctaaatcagtaaaatacgataaatcaccttggcacggtttcagggtgtttttttcgattgagcgttttctgagaaaaatgggcacactaaaaccagccagattttgctatttttttgaaaatctacttcgttgttttattgccacaaagaatttagtcgttcccaagctcgccagaacagaccatcgaactgttcttggttgcggctatctaacgtcaagatcaccttgcgggcgtgcttagtgacacgtcccccgatttttaacaaacggtctcgaaaggtgttgattgtccacgattgttgccgatcgtccaatgcaatactcttcatcaaccgcatcaagtttgatgcaattactgagatccacatgcgcgctttgttggcgaaaaatgaactgctatcagttttgccgaaggcaaatccacctttaagctcgcgaataatatcttcaatcgccgcacgcttgcggtaaacacggacgatgtctttttgtggaagacttaggttagtgacgatgaactgtgtaccgccatgttcatcatttaaaacgataacacgacgtgccttgtcccatgaggcggctcgatactcaaattcatcggtcgtcaactgaccttcaatcgtcaaaagattgtcgagattaacatatcgtccatcaagagccatacgcttcaatcggggatttgacttcaatcggatggtataaaaaatattgttgccttctaacgtttccatcaagtctggcgtggcgaagccgctgtcaccacgcaaaataattgtctgatgttgagcggatagactagttgacagatacctttgcacaaattcagttgcaccattaccggtataggtattgccacttcgcaacgatacctgacgcacggttccagttaaagcatcggtcatgataagcggatggtaaccgacgttcaagtagtgataattaaaaccaattttttgatgaccaaaggtctcaaagtaggttgaatccaaatctagcaccagttcagtgttggctgatctttcatcaattaaagagacaatacgacgatttaattcttgtagctcatcaatgtcttcgttcgtgagatgtgatagaaatctggaaatagttggttgagatgccatgttttgcgcataaacaagtcgatgttcgatatcttgggtcaagtaatctgcaacgtcgtcgttgcgataaccttcgataacttgaatgagcatttgtaataataattctaccttagcatagcgtggatttttacgattatcgttgaattaaacgttattaaagagcctggaaactacaggtgaattcagaaacatactaagcaatacgttgccaccatccgaggtaattggtgccccattgtctgaaactgcaactaaagggttgctaggtaatactttttgagtcataattttagacgctccaatttttgagtatttagtttgtttttcactaacaaaatatcataaaaaagagctcctatggttttcacccagcgggtgaaagcgcaaaacccgctgaaacggtattaacttgctgtttcagcgggtttttgtttgtcttcatgaattatccgggttataaccagttgtacgcatcagaaccatcaactattccacgttcgttgattaacctgttcttttcttcgttagatacttctcgatactcatctgcaacgtccaaatcatccgaatctatgtatggtgagaaattaaacgccacccatctttataagtaaacactttggcgctttcatttgaaacttgaactagcatccccacatttctaaaatcagtgagcactacgtaatacatatcgatatctccaaaaactatacattcaacccaatattaatcattataaccttaaaacgtttgttactatacctacaaactttaccaattcatgaactattggattagcttatttttaatgtgtcataacatgctttacgcataataaaaagcgacacaatttatgcgtcgctttcaatccaaattgattagttattttgaccaaatcaacaaagcagccttaatccactcttgttgacgtgcgtcgatttcttccgaggtcataacgttcagtttgttagcccaagtacgagtaccttcaaactttgaattcgcgatagtttccgctttgcgggatgcagaacccttaaacgccttagcctcttccttcgtgactaataacttattaccaattcggtccttattctcaacattttcattgatataagttaccttcacgtcaggaagaacaatcttgttttcatcattaggatatgccagctccgaaagaacatacttcgctgttttttcagtcggaagcgttgctaatgccaaatcattttcgaacttttggtcatcaaccatttcctctgcaattaatgaattaatttcattcacagtgaaaatcttgccatcactcagctgtcgcgcaatgttagcaaatgacttttcaaacttattcgcagccaatcccccaatcgtaaaattgcgaatcgtgaatgagataatcttatgcaaaacttgcacgatttcagtctcgtcgaactccttttcaaccataaccaaaatcaaaggataaaatgtctttgctcctagttgattcaaaatatacaaattattaatcaacgtttcattatgaaaagaaatttggttcttcggatccaacatagatgcaaattcatctgacaagtcagataacttttgaaccaatcgagttgcatcactcttcgtcaccacacttcgattcaaggcacgatacaacttcttctcagtaacaaagtcgtgggttccgttccaatatgcacgaataaactttgtagcacggtcagaattgaagtctagtggcgtcatcatttcttcccagtggcgttggatatctgggtcaccactagctttacggaacaaatgatttttcaacaaatcggaactgttcaagtctcgaccacgagcattaagcgtttcaaaaatgacaaaagcacttgcctcatctggtgttgaaatcttcatcacaaacatatgatccaagaacgcatcttgcaaatcctcaaggaactcaactcggtcatctaccgtcgcaaagtcctttagtcgctcagctactcgcttgtacagatagtcatacgccttcacaaaattgcgctcactatcttggctcgcttgtcccttaacctcgttgaaagaaaatgcttcattttgaatcaaccggctaaagaaatccgcaacctgttccgcttgcgtaaagttaaaatgaccacgacgaccaatgtacttcttttgaagatcctgggcacgcatacgtgctcgttccgaatcaaggttagtaaaactgtctcgcaacacagctaagaatatcgtcgaagtcgttactcgttgctgaccatctacgacataatcattgctatcaagcttattcgtaacaacttgccccaagaaatgatcctcttcattctcgtcgagcacctcagccaaatcattccaaaaatcttcccactcttggtttgtccacgcataaccacgttgatacgttggaactgctaaattcttatgatcggtaaataacgtccccatcgttacacgctcgaaactcatgtctgccatttttatcacacctctttgtaaatactgtttacatttattagatcacaatattactaaagtagctatgaaataattccgacaaaaagcagagcatcaatttttcgacgttctgctttttactgtattcgtgtaataaaccaattcataattgagttaacttaactagctcgacgtgctactgtactaccaccaatgtcaggtcgatgaagtcgaatcaaatcttcaacaataggtttctctggcaaataccctgttgcaatccacacttcaatcatcgcccggaatattggtcgttgaattaattgctttgcaaacaaccccaactttgtattgtaatcgcacttgataaacatgctacccaattcagaaactttaaaataaccgcccttcttctgcgctaatccgaagtactccgctgcgttggcataataatcgaactgtcgaatatcgaacttaaacgattttgccagacactctttcgttccaacagaaaagatatctccttgctcgctgctcttatgctagatttacggacagatttttctctgccctgtaaactaatagcagaagagcattttttatatgattcgatattcaccagaatttaagcaatctcttgtcgagatgcacaaccaagggcgttcttgaacacagaagttaagctcaatagcgccgaaagtagttggaggatcgcttcctgcgaggataggacgtcgcgatgcaacgtaaatcgtaccagaaatggtgcggtttttttgtgcctattggcggtataatgccgttaaaccatgcaaagggggaatgagtatgagctttgacattgttttgatacggggaaattcagccagtggcaagtcgacggttgcgaaagcactacagctagttttaccgaatacaatgctgatttcacaagatgaaatacggcgcaatatgttacgcgagtctgaccgggacggttcagatacgatgcgtgttattgagctgttggtggcaccggcgaaggagatgaatcgtttagttattctagacggcattttcagacaagatacttatggtgattggctggtgcaattgtttgagacgtatagtggcacagcgtggtatttgaatatctcattggcagcgactaaggttaggcatgccggcagagcgcaaagcaaagactttggtgatgaacatctagaagcgtggtatcggccacatgatacaatcgatgcactgaatgaatatcttgtccccgaaacatggacgaaagacgacacagttaaatcaattttacgtacactatctgaataaataagaatcgtaattcagaaaaggtcccgcatcgctatatgtgatgcgggacctttttaactaatttggataagttaatgttttcaacgtcttgttattagaatcaaccacttggatagttaagcttggatttttggtgcccgcatcggtcattgagcgaagtactttgtttgccaattggttaacttgatcaccattagttgcaagcgccatattaatcattgatggcgaaagcttatcagaagtgactgtcaatgtgactgcgtcgttttttgcgacggcatttgtatccgtgaacagacctcttgagctttgcttcaagttaaaggcctcgttgttcaattgaaccgcgacttgatccggtgtcattggtgctacgtcaacgtttttaagttttacacctgtagttaatgtaccatccttaatgggtagcatttctgttacgcggcgctcaacaaagtggcgttctaactgaatagcgccaaagataatgatgcctagtagcagaactattccgatagctattttccatccctttttcatgtgttttcctcctaaaactgtacacaaccactatactgctattttatgcaaatggcttaaattttgaaatgagatagtttcccaacacgagcagtatgttcgccaagacaaagagtctcagactaaccattagaagtgcctgttggtcaaaaccgatagtggccatatagctaaatctaattaaccaggtagtgggaataaaaaacatcgtgtaatcaaacaatgcggtttcagctattagtgcgatcacagcagcacctgtcatgattaaataggcaatcggcgcattaaaattccgcgatagtatataagtgatttgagctaccattagcaagttgagtattaatagtattggtaaccaacttatggatatatgcgtcatatgaacgaggatgtcataactaataagcgcaagtatgctatgaagcatccaatgggtaagaacttgcatttcaccccatgcaaagtaggcatttcgcagatgagtagtaatcataaagtttccagccaagcggtcacactgtactgtttgaataattgagatgctcattaacactggactgaataaccccatgaatagtttgacgaggacgacaaactgaccgggttgttgtaggcgtggtaagtaaagggcgagtgccaaagttgccataagataactgagtagcacggctggtagtaatctttttcgatgtttgataaattcaacgcctacaattttacttgtcatgtgtttgcctccttgtatataagtacaagatgctttctagcaccgcaaccatgacaaacgttgtgatgattgctggcccaataaggttattactgtaataatctatagccatgccgtttggattgacgccagccagatgcgcaatgttataagttgcaatcgaccatggggtaggtagcgtacttaaacccgatattagtaaagataacactgctaaaacggcaataatattaggcaggttgataattagcaaatagatcactggtaataaccataatgcgaatagtgctataaataacattggtagcagaaccccctggtagaggttgagattggacaagccgtatgtaaaggttaaaaatgcaagggataaaacttcgtagagagccaaacctttaaggaataaccagtacagattcaatactagggcgcgatagtagtttggaatatcgatgactgactgacgcacattaaagaaattaccggcgttttgttcttgcctagctttttcaaacgctaacacaactaggccgatatatagccagatggttacaaagttattttggaaagtcgccagacagacgttgtttgccagagacgcgggcaacaaccagatgcttgtgaacccagcagcaataacatcggtagcgatgaccacccaattgatatgactatggcgcagcttcaagtattccatggatagataatgattcatgatgctatggtgcctcctttagttattatgctcacggtagatagccgtgagttcttcaggagtgtagtggccactattcgacgtgtaagttagttcaccatgcttcagaatagcaaaagcatcaaatacagttgccagttcggtaatctgatgcgtcgttatcataatggtcatgccatcagcagccagggactgtacaatcgacttgaagtcatcaacaccggccatatccaaaccattagtcggctcatcaagaattagaaactgtgggttatggataatagccatggcgatacccaaacgctgcttcattcccagtgagaagttctttacctttagtttgtcattaacatcggctagaccgactgtttgaagtgttttgttaatcgactcagctggtaggttgtataagagcaccatgattcgtagattttcgtgcgcggttaagttagggtaaatggcgggtagttcgattagagcgccgaagttcttagcttgatcacgtgatagtggctgattgtcataagtcattgatcctgagaaatgtttattaaggccgagaatggtttttaataaggtcgtcttaccagcaccattgtcacccaataggccaaagatgctaccggctggaatattcagtgagacgtcacgaagtattcgttggtggcgatgctgcacagataagctttctatcagtaaggtattgctcatattgttactccctaaaatgtaaatcactgcttgattatgggggtgctccctaaaatccaagacggttaccgtaagcatactgctttaaaattaactgagtgtatgcattattgaacgtatcattaactcttctatataaaagatagatacttaatcaatcaaacattgtcatagtccggttaatagtagatttgactggtacgttggcgaaacatttggtaggatataaatactgttttaggtattgcgtcaattctttaaaaggggtaatatagtcaagttgtcttttgaagaaagcaaccccaaaaaagatgttcaacaaagttgttgacattcagtaaaacgttctgtattatatattaagtcgtctcagagatatgaattatctatgaacgacgtatgaaaattgattgaaattagttgttgacttttcattctttcttctgtaatatagattaagtcgtcagggcgacgacgtaggtcattgaaaactgaatatcgtttcgatgaaacaaatgtgtagggtcatcaagctaagcttgatgcaaaaacatttgcgaagtcaattcgctagtaaattcgtttaacttctgttaaacaacaaaaattgagttacaatcaattttcatacgtcgttcatagataattcatatctctgagacgacttaatatataatacagaacgttttactaaatgtcaacaactttgttgaacatcttttgggcgttgctttcttcaaaagacaacttgaacatattaccccttttatttaattagcgcaacccctttgtttaacagaaacattttctcagttcaaatttaagtcgtgctatactagtagacagtaataaaacaaattaaggaattaaacatacatggcaaacaaaccagaaaaggtggatgctgctgaatttctagcaatgttgctacaatacagtcgcgacttccactacaaccacattaacgttagtgtccgtttgaaccgtaaccctgcctacacacgtcaagtgatgaacgtgatgttgaagcgtaactcaaagaagtacggtaacgacgaacgtctatacgcatcaatgactgccgatgaagcaaccaagttcctatccctagttaaccaactcaaggaagaaatgtttgctagcttcgctgacaagattacttggcataccgatctactcgttcgtgaagagcaagaattcggttaccgccaaatccgcgaacgtgaccaatacaataaccttgaattcgaattgctactatagtcttctaccccagtattcacttactggggtatttttttacgcaatttcatcacgtccagttgctacaatggcgatactgagaactcactcgaaaggaggaaagtctatgtatcgtcaactttttgtatttggtagccgtattcttgggcttaatcacgtctggcaactttctggtaaagaactatgggaagagttagcaagtaaacctgccacagctactgagcctagcacgaaattgcgtcacgaattcgaagttgtatctgaagagtacatggagattctagtacctaagaattttaatcttcataaacccactactatcatgctttacttacacggtggtggttttatcgagccaataactgcctaccactggcatttcattggtgacttagttcgtaatacggatattccgtgtgccgtgttggattacccactggtaccacatgcaacactcgatgaaatctatgaacgcgttcaccaagctatctggcgcttgcgtcatacctatgacggttgtgaggttgttttagttggtgactctgcgggcgcacaaattgcacttggatacgtgcagctcatggaggcatttcctattgagcgtatcgtcgcaatcagcccaatggttgatatgacgttagctaatccagatattgtggatgccgcaaagcacgatcctgttttgtcattaaacgccatgccggatttgatagaagctattcgtggcacacatgatatcggcgacccgattgtctctcctatcaacggcaattttgataaccaaaagattcttttaatcagtggtacccgcgacctaacaaacccggacaaccgtatttttgccaaaaaattcgcagacaacgtgacctacattgaaggtaccggcttgccacacgcctatccaatttggccacttacacgcaacttggctgctaagaatcaaatttacgattttattatgggttagccttatgaaatacgattttaaaaaaatggccacggttgagtttaattcaactaagcgccctaaacaagttgtggttcctagccattcttattttgaaattcacggtaaaggaaatcctaacgacgcattgtttcctgattacatcgcagccttatatagcgtcgcgtatccgaccaagatggccttcaagaaagctgatccatcagttcatggtatctacactgactacacagtgcctccgctattaggtgattggacaatcagccgcgttgccgtagaacgtggcgcctggaccaaagacgacttcgtattcagactacgcatgcttattccagactttgtaccaattgcacttgccgaaaaaatactattgaacgctaaatcagcaggaaaagctaagttaattgataaagttaatattgttaagttacctgagaagcgtgtggttcaaatgttgcacgttggtccttatgacgatgagcaaatatcatttgatcatattgagatgtttctaaacgagcatcaactaacccgaacttctcagaatcatactgaatattaccttaatgatgcgcgtcgcattgcgccagaccggttaaagactgttttggaagttgaggttgcgccaaaataaaaagtgatcacagcaacgagcctgtgatcactttttttatttcatggttaagcagctaatggcaacgcatagacaacttcaaacttttccaatacaacgtgcaaccgactgaaatcgacgttttcaccaacttccggaaattcacgttggaaaaattcttcatgcgtacggcgccacgtttcaagtgacttgtcaccttcaccctctgcataggcatgtgcgctgtctaccttgtgataaggcactactgaaacttcctttgtgcatagcactgctactggattgccactaccgtccaataagatatcgtaacaagagttagccgttggaatcggctccccttctaattgatacaactcatatgcactagctgtcgccgttttttctccggccaacgtcaaccgtgcaagctcatcagcttgtgactgtgacgccccaaacgcccatgcactaccgaataccgcatttggcaggttgtgttcttccttgaactggttccaatacgcttcttctactggtttcataacgtcccccatatttagtatctaagaacaagtctatcaaagatacaaaaaaagtgccgacttcaacaatcgacacttacacatagattagttttcaggtactgggtgttgtgcagtataaagcgctgcaatgataccatgcgccactgatacattgagcgaacgcaccgatccagtctgaggaatataaatcatcttatccgcagcttgaatcaattcatcagccaatccaatttgttcctcaccaaacaaaaagacactcttctcagggaactcagtctcaaagacattgtgtagttcataacctggcgtgttatcaacggcataaattgtgtatccctcagcatgccattcatcaaacagggcttgatagtccgtaatcttacggtgcttaatgtgctcgtagtgttgggcgccaaccgcaccggttttattccacttctttgcaccctcttcattttcaggatccattgggttttctggattcaaaaagacgatttcacgaccagaaaatgcgttatggttacgcacagctgtcgctttattgaaatcgtgggttaaattctgaagtgcagtaatcatgtaaccacgacgttgatccaaggcctgcataatatcatcgttggtcatgcctttaaaatcatcacctaaattacgataatcaatggcatttttcaaatcaatcttactcatgttttttcttctcttcttatatttgtatgtaaaactagcttatcatttttatgtacaaaaagaaaaccgcaccatctctggtacggttcatgttgcatcgcgacgtcctatcctcgcaggaagcgatcctccaactactttcggcgctattgagcttaacttctgtgttcgaagagatagttaaccgtccaacacaatgggtagcggttaggtgtccgatcacgggttgcgccgtgatgaagaaatatagcatgcggacaagctgaacgagtaatcgttcgaagtcagtagtcccagtatcgtgtatcgggttaaacagttaccgtatatcaaaaaaacgccctgagaagctctcagaggcgtttttaggtgtcagcaagataaatagacaccaccagatataaaacaacgtcaaaacacggacaagggttgtgaggggtagcttgaacataatctactgtgatagaaatatcagtcgttgcgagatgcactcaacgaaacacaccaattagccccattaaggggatagttggtggagtgtcgagagagagagccttgcaggctatccgcaatgacttgattggtattttgttcaacatgttgtttaataaggggtttaaacaggcgtcagcatggaggggtccaggggcttgcccctgtgtctgccgaaggctccaattagccggtggaaataggagacggggtaggcatgaatttggctttcacttttgccaaatttgtccagcgagcgtaggggtctttttagcggctaattagtgttagatcgataaaaaaattccttgggcatctgtcagcgttttttctgacaagcgcacttacacgtcactttaaaaaagtgacgaaattggtcccctgattgcatcagaatgcgcacttatactccactgataaatcactagagtttgtgcttaaaaatttgtatcagaagttggctagccaacaacaaaaaaaagacggatctattaatccgccctctcatcaaatcattcagttttttctagtatttcgccagtctctttatcgatttcatttgataatttcttaacaaaaaaatgctctgacccagttaaaggatattctctttttacgtaaacttctttaaatccaaatttgggataaaaatctttaccttgaaaatcaaatgtgtatagaaatatatttttgcaattactacgtatagccaggtcttcggctttttgtaacagctcccgacctaacccatttctacgcaaactttcatgaataactaaatagtctatatccatccaattaccaaatatttttcctgaaatcccccccataacattctcattatcatcttttatgtaaatagcaaaatctgtttgatttgcagtttcaaaattttgcctattatactttctgatcatattttgtaatgtcattacatctgatttttctggtaataatgtttcttcgaatttcataattgcttccccctaaattacactcttacttattattcaatacttcgtctgtatctttatcaatatctgacctaccatatcagcgttcttgataaacagcatcgcagtataaccttatcagaacaagcaataaatgagaactttgtttaaaacaatgcgcacttacacacaacccaattgtagggctgtatttgtgcttaaaatatgtactaggttgttgccggtggcaacagcttaactaaccgctcgttttttgatagaaaaaatccagtcaccatccaaaaaaggacagcgactggatttttttgtacatgtacttaaaatttgatgtttaaaattatactagaagttgcctttggcaacaacctaactaaccgcccttcggttggtataaacacaaaaaggtttagtgaatattcactaaacctttttgtgttttaggaatgataggtaagtatagagatgctctataggttacaactaatatatcatgttctgataaaagtgaacgtaattagctcctgatatggcgttaatttaacgggtaaatattggtgacaacaaaaagctagtcgctgtccacttttgtggccggtaactagctttttgctgttgatagtattcaaaaatatagattgagtatttgagataatattattctaactccaaatccccaaattggtagtggcacttttgccttttttaggagtaattggtctaaattgtgaaaaagcccgaaaatgacgcttgtgaaacgcattctcgggcttttttagcgtttgtgaattggggttgctgcacaaagtgcgccaaaccgcgtcagatcaaccacttgggataatgcacgttatgttaactggctttggtataagtgttaattgatcagctatattagcagattctagattctatctaaaaatcaattttccgatatgttgcagagtatctgattctataataatcattaatcccagtacgatgtaggtaacagctactaaaataccagagtacttaaacaagaaattttgaagactagtaactcgacttacaaaatcagtgaatagtcccataaacagaacattaattaaaaaaacaatagtgacgacgggtatgaacgtagtttgtaaatttgcaaaatacggagtaaacaggccaatattatctggggcacatgatgtaatagctaaaataaacattgtccacataatttttctagaacttgtggtatcgttccctttattaatatcgtccaggtcttcaggacctctaaataaggctataaatccaaacactagtggtataaatccgagtaatcccagcaaccacttatccggaattaaacgaagtcccaaagctaaaaatagactgattataattaagaatatcgcccccataatggaccctaaaatgatttgttgtttttttccagcaattgggtgtgaggcaatcattacaacacttatcaaaattagatccatagcagttgaccaatatagaatagttccggtaataatttcttgtaacatagctatctccaatacatgttttttttgtcattcattagtttattacaggtgttcacaataaggtatgctcaatatagacatgtatttttaataagttaactggattactaagtatatagagactattcaatagctgtgtgatgttgagatttttagggatcattaagcattgcgtaaataagcaataacaagtattcttaaaacatacacaagcgaataaaagaaaaggcgcttatcaagcctgcaagcaagataagcgccagtgcaaagaatgccgaaccattcagagcacgttgtcattcaatatgtaagtacattataaggtacttaccgagaatgcgtcaagaaaagaagaacttctgacgagagacaatgtgactaggaatagctgcattgtctctctttatttttgcactcgaaacccaccacgttacggtgacagagtagaacgcactcaggacaaagaagcctacacggaaagtaggacggcacgtgaagagccttgctgtatgctccacagacagcaaaaacagagacgtggagaagagatagttaaccgtccaacacaatgggtagcggttaggtgtccgatcacgggttgcgccgtgatgaagaaatacaattgtttgccaacccttcaacgcgataccatcgccattgaagtagaaccaatccccgtttcggtttactgcaaaacgatttgtaaccatattaccactaccttggtcaaagtaacgtaagttaccatctgccccaatcaaaaattgatccttagcttgtgaaccacctgcaaagaaatattgcgtgtgtccatcaataatcatcatacgatctgcgaccatattaccgtttacatcaaagtaataagccacaccgctttgatcgactacatatttagacttaactgctgagccagtcttgccataataaaccgtgttaccagatgcattttgtaaaaatgcttctcttaactcaacgccatttggcaagaagtaatattgcttaccgttaatggtttgtgagcccgtcaccatgtatccgtttgcatcaaagtaataatattgtccatcatcaccttggataaacgactgtttagcttggtaaccacttgttgaataataggttgtgcccttttcatctgtggtgaacccagtcatggcatcttgattcataaattgttttggcaagaaggactcatcgttcgcattagacgtaatcttgaaatattcttgagatgcaccatctttcaatacgtaatcagcgcccttaccttggatgtcagaaccattgaagtattttgcagaccattctttaatcttcgtggacccatcgattggtacaccagtcgaaatctgatttgttgtaaacaaatcagggtgttccagacgcaaaagatctaagaactcaccaccatacttagcttggtattcaccgccgccctttgaatttgtaacatacaactggttttgcagatctgaatcctggtttggtgtaccaaagttattagtacgattaacagcaactacttcttgacctggcaaattataaatttggtcagggacaaagtcagccattacctgaataccaacactgtgcattgctctaattgcatctgctaggtcgtcaacgtctccgtactttgttggagtattaaagcccaagtcatagcggtctgtaaacgcatatccattcttaataatagaatccaaaaatgatgtgtcatcacttgaacgatattgtggtgcaagttggaaacttgtcacaccccatgacttaaacaaatcagcattttgagcgatctttacgtttgtaaactcatcgtgggttgttggcatctcttggaaattagaaaaaccttcataaatcacatttgagtccaatgctgcatttgaatgtaaggtgtcaccagttttgtttgtagcgctagaccctgttgcgcgcgcatcctgtgtgtcggatgcaccgactggtacccacactgacaagaatccggatacctcaacgttttggtatcccttaatgtctgcgctagtgaaaattaagtcaccatttgcatccgtatagcgaattggcgcgccattatcggacgtgtatttcattagtccatctgtcgtcgttaacaacaaagcacggtatgcctggttggcgtgagcgatacccatatgaagggtcacagtgtctcccttcaacgctaacgcatcattattgctgacaatcacgccaattccttgggtacgggccgtcgtgctacccttatcatatgcattcatgatcccatcaccaaagcgaactgatgttaagatatcgtgtttatctacagccatggtttgtccaccagccacatacttaatacgggctttcaacaacgctgagatggcatcgtaatatggtgacttagttgccatatattgaccatcatccgtatacatatcaccatagtaaacacgtggaattgtgtctttattcgttagtaacatggcatacgctgcgggcatgttgtattgcgtatacttcttattaacagaattcatatccgcatcgtataccttaaaggctgccgccaattgttccatagatggcgccaatgaatttttaacatccggatacaacttcgcaacaatatcaccgataaccgtttgaacttcactatcgtgtgcacggacaaagctgtaattaggaattgcctgatcagacgtattgtccttagaacggtcgaccaaataatactccataaatcgtcgcatcgcactacgattatctggattttttgttaatgaccaaatcaattgggtatgcatgtaatcatccatcgtcaactgatcactaccgtggtccttgacatataatgggtcattgtggccccaatcttccaaaatagacaaatgttgattagctgtcaaatcgtttttatcgacgccatacacatctctaaaataagcggctgtaatgtttagcaggtcggcatccacgttgtctaccgcatccactctaacactatcaaagttagctgacggatcgttcttaacaatttcaccgaaatgcgtcaagaagtacaaccagttcaattgttctgcttgaacaactgggttagaattatccacgtcattggctaacagcaactcatatccaccctcagatgtatcagtgttgtaatgacgcgtaccatcttgttgtgttggattacggttcatcaaacggaaatttgagttcgcatcaggcgtcaaaacactgttaatgtagcttaatgcgccaccttgaaggtggtcgttgcttggcgtttcactagtaacattgtatcctggttgtgacttaatgaaattgtgcatcgttgttcgcaaccattcaacagactttgtctgttgaatcttcaattcaatttgcaattgaaccgcgtgtgctgcttggttcacagttgccaacatcaacagcgtttcgtatggtacgtcaacgaacgtaaagtctggtgtgccagtcacttgcaaccaatgcatcgcgacgtcctatcctcgcaggaagcgatcctccaactactttcggcgctattgagcttaacttctgtgttcggtatgggaacaggtgtggcctcaatgccatcgtcacgacacggtatttaattgagaaaatattagctctctcaaaactgaatcataatttgtaaatcaaacttcgtttgagccttacaccacgttttcaacttggttaagtcctcgaaccattagtactagtccgctccatgcgtcgccgcacttccacttctagcctatctacctcatcatctctgaggggtcttacttcataaagaatgggaaatctcatctcgaggcgagtttcacacttagatgctttcagcgtttatctcatccgtacatagctactcagcgatgctcctggcggaacaactgatacaccagaggtacgtccaccccggtcctctcgtactaagggcagctcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttgtccgttgagcgatggcccttccatgcggaaccaccggatcactaagccctactttcgtacctgctcgactggtaagtctcacagtcaagctcccttgtgcctttacactctgcgaatgatttccaaccattctgagggaacctttgggcgcctccgttaccttttaggaggcgaccgccccagtcaaactgcctgccagacactgtcttccaccacgcttagtggtgcgagttagagtggtcatacaacgagggtagtatcccaatgacgcctccaccgaaactagcgtcccggtatctacggctcctacctatgctgtacaagctgcacaaacactcaatatcaagctacagtaaagctccatggggtctttccgtcctgtcgcgggtaacccgcatcttcacgggtatttaaatttcaccgagtctctcgttgagacagtgcccagatcgttacgcctttcgtgcgggtcggaacttacccgacaaggaatttcgctaccttaggaccgttatagttacggccgccgtttactggggcttcaattcgtaccttcgccgaagctaagcactccttttaaccttccagcaccgggcaggcgtcagcccctatacgtcatcttacgattttgcagaaacctgtgtttttgataaacagtcgcctgggcctattcactgcggctcagctttcgctgagcaccccttctcccgaagttacggggtcattttgccgagttccttaacgagagttcactcgctcaccttaggatgctctcctcgactacctgtgtcggtttgcggtacgggcaggtaaacactaactagaagcttttctcggcagcgtgacatcacggacttccctactttatttcggtcctcatcataacttgtccttaaaagataaagcatttaactcgatctaagacttattatttaacccagcatatccagcagctgggatccgttagccttctgcgtccctccatcgttcaaacatgttcacctggtacaggaatctcaacctgttatccatcgactacgcctctcggcctcgccttaggtcccgactaaccctgggaggacgagccttccccaggaaaccttagtcatacggtggacaggattctcacctgtctttcgctactcataccggcattctcacttctaagcgctccaccagtcctcacggtctgacttcatcgcccttagaacgctctcctatcgcgccacttacgtggcacccgtagtttcggtggtgtgtttagccccggtacattttcggcgcagaatcactcgactagtgagctattacgcactctttaaatggtggctgcttctaagccaacatcctagttgtctatgcaactccacatccttttccacttaacacacacttagggaccttaactgacgatctgggctgttcccctttcgacaatggatcttatcactcactgtctgactcccggacatacgtgattggcattcggagtttatcttaatttggtaacccgagatgggccccgcaccaaaacagtgctctacctccaacacgctacattccgaggctagccctaaagctatttcggagagaaccagctatctccaagttcgattggaatttcaccgctacccacacctcatcccagcatttttcaacatgcacgggttcgggcctccagtgcgttttaccgcaccttcaccctggacatgggtaggtcacctggtttcgggtctacaacaacatactaattcgcccatttcagactcgctttcgctacggctccggtctttccaccttaaccttgcatggtatcgtaactcgccggttcattctacaaaaggcacgctatcacccattaacgggctctaacttcttgtaggcacatggtttcaggaactttttcactccccttccggggtgcttttcacctttccctcacggtactggttcactatcggtcactagggagtatttagccttgcgagatggtcctcgcggattccgaccggatttcacgtgtccggccgtactcaggatcctgtaaagcgtggtgatttcatcacagaaccacaattctacaagttggcaattaaggcaaacaacgaaacggctgaacgtttccaagattgggtaactgaagaagtgttaccaagcattcgcaagacaggtggttatcaagcaaagccaatgaccccaatggaattgctagaaacgcaattcgaagcattgaaggaagttagtgccgaccagcaagagttgcgtggcgagtttgccgaactaaaggaacagtttggactgcctaatgatttacgtaagcgatttacaaaggcacgcaacaagcgagttgttgaagtgatgggcggttactacggaacagcctacaacactaagaagttgcgcaacgcagtataccgtcaacttggaaacgtcattaaagaccgttttgttattagtgagttcgccagcttgccaatgtcgaagttcgatgaagcaatgcgtttgactcaaaactggcaaccggacgaggtattgacgtttgccatcaacggagccaatgaacaagcactattggaggtgtagatatggaagaaaagttgaagccgttgattggtcagaaggaaatcgctgaagaggtgtttggtcattcggttaattggtttaaagaccacttacgtttctccaagaagtttatgcaaaacgtaccgaataagacgcctaatgcataccgaccaacatatttgcgaagcgatgcagaaagatttaagaggctgaacgattggtattaggttacatgatattcgcaatattaatgttggtgatgttcgtggcttggttgtttgacttcctcgacgctcgcgatattcacttgcgaccacagctggaagaaaagattaaggaggcaactgatgatcaagacgattgtaaaggtattggctaacgcattcgatgcgattgcactcattggacttgatagtcaatttgagaagcgttccaaaaaggcagccgccgatgttggctgggatccagatgaatattggaatggcttcgttgagtacaacaactcacatcaataacaattgaatatgggtcgcgcatcgccagatgcacatcaaccacttacatgtaatattttttctcttactgtttgtctcttaacaacatgttggtgtgtgtcttggggtgtgcgacccagaaaggaatggaaatgaatgagtttactccggagatgatttcaccgaaacaattggtttcaatcttcatcgttcaaggtgtcgaaaacttgtacgacgaagagttggctgaccaattaggaactagcgtggcttcgttgcacatgatgcgtgaagcaaagtttactggcatctcaatgccgccttggttggcattgaatgtacatcgtattttgtcagagaagcactctcttattgaattcacaaaacaaatattggaggacgatcatggcggattatgatattggatcaacaggtgttgcgaagttgcatcacagctttgcaccagatgaggagtttgacatcgaagcagagcgtaagcgcattctgcaacacaacggtcgtttggaacgccgtactacttgggtaacgcctggtgacaatcaggtgaagaaagatgagtacgaaagtcggtaccaagtgttcaagaagatgcaagacgcaggtaaatcagcaagtgaaattgcatcagctattggagtgtctaaggtgacgttgtcatcacttcgttatcgtggacgataccaaaaagaaaacgcctaacggctgcaaccgttaagcgcgaaaaggggtaaatctgtttaggatgatttactcctccagagtaccacaaggaggtatgaaatgaaacacgaattgcaattagaagcgcaaaaacgtataaatcgagccttcaaggtagaacaacgggataacaatgacggaactgtttcggagtttgaaatgggcgttgccaatgttctgaattgggtggctgaccatgtttgatgaactacttgatccacatgatgatgaaatgccttggggagaagattttgaaggtgaagaagtagcccaaggtacagaaggttgggacacagatgaaggatttgtcccagatgaaaaagaaaagctgaagaacagtgacttggtttcactttcatatcttcaacagacgttgacctttttgtccagcgcggtccaaaccaatctcagtgaactcgctcgtttgccaaagacccattttggtgtcggtgccgaccaagataaaattgatttattcgaagacgtgcaaattgaaggagatcaggtccaacggatgtttgagattgaaacccaagtcgttgaccgaatcgatcataccttcaacagccttgctaataacaacctgaacgatacaatgaaatttttgacaatttggtcactgaccatggctgtgccaacaatcattaccggattctatgggatgaacgtgaagaaactcccgttagccgggatgcaatatgcttggatgctgactttggggatttctgtcgccttgattgtggcgatgctgattatgctgaaggtctggcggaagatgtgatgggtgagtggcttttttggaatgtgtatagttgagcagttatgctattttgagcacccttcggcttctgaaatacgctccgacgaccctgcccccgggtcttgtcacgtgttggtgatctattaggtatcaactatgctaggcacacacaccatgcgtaaaacaggcgcttacttatcttgtcctggatcaagctagtcgtgagactacgttagatcaaattgattttggttaaatattttaattacaactacaggtgtaactatagctgtagttgtaattaaaatttccttatcttgaatattgattataatttttgattgagatgattacgatgaggaatatatacacactcagaataagttgagatagaggttcaaagtcaaatggtactgatgaccggtaaaatttaatattttgaaccttgcttaggcagctgacttcacattgttgagattagctgccttttgcttatagttcattgagtagaaactattcttgaatgagataagaatatgtagacggaagtttttgaaactacggaagccgtatgccgtacgcttaattgctttgattttattgtttgaaccttcaattggtccatttgagaatccgtagataaagctgtttattatttcgtcgaagtgcttgcggatagtgcgacgagccttcttcattgcctttggcaatgagcggtattgggcatcattttttgtggggtatagaacagacttgagttcagcttcatcacgagtttcgatggcgtaaagaatcccttggtagaaagcgtatgcgtcacgcagttaatcagagagcgccagtaggcggtcgataacttctttatcagttaaataggcatgcttaaaattgattcaatttttgctggtcgcgtaatcaagtgcagtttcgtgcttcataagtagtttccagaaccgctttagttgacgatactctttgctgtctgatccgaattgcttcataacgctgattcgaaccttgttgagttcacggtatgcttgagttacaacgtgaaagctatcagccacgatgtttgcgtttggaaataaatccttaatcatggctcggtaaggagtaaataagtctactgttatggttttaacagcagatcgagctgctgggctgtattgattgaaataggcgcggagctgaccagcaccgcgatccttcatgacatctagaatgcggtggttaacagaatcgattaaaatcatgctcattccactagttgcgaacatacctgatttgaagtcatcgaacgcgatgttttggggtaggtaatggaaatttattttgttgtaaacgaataagccttcggctgcgcgcattacggtttgtgttgatatgttgttgtctaaggcaatgtgcttttgactaacgttttcacttagtttcattgctacggtttgtttaactttatcgatgatatggttgtttggttgaatgtcgctgaggtgcgcaatggacgtgtgtccacatttcttgcatagaaatttttgctttcgaattgagataagtatgcgagatttacgacagatgacagatacagttaatgaatataaacgattcgatcattttgaaaaaagggtattaagtgagcctttaattgaaattacaaagcatactactttcaatgtaacgtacgaaaagattaaaaaaggacgcagcatttatagcattgtctttcacattactagaaaacaagtcgcagatgacattagttacaagatagatgattccgcgtatattgacggtaaaataagacaagaagaaagtgaaaaagatcttgtgtatgaagctatgaaaagtccatacacaaagttgttgatggaacatttcttgttgtcatacattgatttgacggatacggctattttgtcagggttacagaaaaatgtttatccactctacgatgaattaaaagacatacgtggcttaaatggtgttaaagagcacttagcgtatgtcaatgatagacaagataattattcaaaaaagaacattgctaagtatcttaaaaaatcgattgaacagtatctaccaatcgtaaaaaggcaggatatagatcatgagtgacaatttaaaaaaattcgagaacttgctgatgaattgggcgttccaaagcaggctatatggaaagtaggacggcacgtgaagatccttactgtacgctccacagacagcataaacaaagacgtggagcagagataacaaatagtacaaatgcgggtagctggttgttatcccatcatgatttgcaccttggtgaagacatataggcgcggaaaagctgaatgagtaatcattctcagtcagtgtttcctagtattgcataaatgtttaaacagtccccagaacgcttatatagcgctcaaatgacgtcaaaatgtagtcaggttgtaagagatagcttgaacataaaacattatggcagtagccagtcgttgcgagacgcacgtaatgaaactaaccaattgccccattaaggggatagttggttcagtatcgggagagaggcttgcaggctatccgcaacgacatcgctaaacgctttttgtttttaattctttttaataaggcgtaagggttccaagggattgcctttgtgtctgccgaaggctactagttagccggtgtacatatcaagcggggacaaattaacatggctttcacttctacgaacttgtacagcgtgcggtggatagcgttgaattgatccttgtagttgagtgctgcattagccgctgtttatttaatgaatcggctatacgtataagtcgtatatatacatgtatgtataaacagtatgtatacgtactacgtataatgtgttattataagcataatgacattgaaaaggggtgtgagacatgaagatacttacgttttcagcgattaaaggtggagtaggtaagactacattggctttcaattatggagagtggctggccgaacatggaaatcaagtcctatttatggacttagaccaccaaagcaatttgagccaaacgtataatatttatgccactgaaaatacagttgcaaatatattttctggtcaaggacaggtagatattcatgatgttagtgataatatcagtcttattgctggtgacttgcatctagatgatgtggaacgagaaatcgaaaataaaaccaataagaatatgatgctttacatgtggttaagtgataattttgattgtttaaatttaggacgatttgattatattatccttgatacacaccctgatttttcaattgctactagaaatgcagcgattatcagtcatgcgattattagtccaattattccaagtgaacacggatataatgccaaatttaatttggaagaacgattaaaagaattacgtgaagaagcaattgattttcaatcacgcaaatcatatgtgacagcgcaactttatataaagttgcgctcttgatgcaaaaacatttgcgaagtcaattcgctagtaaattcgtttaacttctgttaaacaacaaaaattgagttatactcaaacttcaaattgagagtttgatcctggctcaggatgaacgctggcggcgtgcctaatacatgcaagtcgaacgctttgtggttcaactgatttgaagagcttgctcagatatgacgatggacattgcaaagagtggcgaacgggtgagtaacacgtgggaaacctacctcttagcaggggataacatttggaaacagatgctaataccgtataacaatgacaaccgcatggttgttatttaaaagatggttctgctatcactaagagatggtcccgcggtgcattagctagttggtaaggtaatggcttaccaaggcgatgatgcatagccgagttgagagactgatcggccacaatgggactgagacacggcccatactcctacgggaggcagcagtagggaatcttccacaatgggcgaaagcctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctaggtgtttgagggtttccgcccttaagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgacaactccagagatggagcgttcccttcggggacaaggtgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgacctgggctacacacgtgctacaatggcgtatacaacgagttgccaacccgcgagggtgagctaatctcttaaagtacgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtggggtaaccttcgggagccagccgtctaaggtgggacagatgattagggtgaagtcgtaacaaggtagccgtaggagaacctgcggctggatcacctcctttctaaggaaaatcggaaacctacacattcatcgtttgtacagccagatgatattcgttggccaacgaattagcagaacaaccctcgttgtacaagtcaacaattgatgatttaaattcagttgagtatctcttagctttcatattaaaaaaactatacttggttatctcggattatgaccctataatccacacataactacgttgatttctgggacaacatagttatatacacaaaaaagatagtcacgatccaacaaaggggcgtgactatcttttttgtacatgtacttaaaattttatgttaaaaattatactataagttaggttaacttgatacttacgggttattttttatcattctaacttgtgaaaaagtcaaaaagacgtaaaccgtagtgttttttgatgagctatgttgtattatttggcaatcatattagtcacacttgcattattttgttattaatttagcactaatttagtgctattataaaaacaaccatattaatattttattataaaaattttaatggaatttttatcttgtgagtttattttgttacacttattaagtatcaagtatacagtattaggtaatcagggaggccactatgactaaagatagtacgaaaaaagataagaatgaagaagaagatctttcactcagccctcagaaagaagttaagggtaagccagaaccggcagattataaaaaagcagattgattttgattaatcggcaagcaatccttaaatgttgcgctaatcttaactaagatataagcagctaaatttgtgaaaatttagctgctttttttgtcaatttattggttaacaattaagaatgaccaacatttgatattaaaatatctatcgatagataagaaactaggcgacgcttaaacaggcaaatgaactgaaccccaaaaattggagtgaagtttacgtggctaactgggcggaaagatttcggtattgaaccggagtttttccggccagttttgttttcaatccgcttattgttgtagtaatagacatagttggttatggcggacttcagttcgtcatagctttggtagtggttgttgtgtacagttcctacatttacgatgtggaagatactttcggccattgcgttatctaggcatgtcgctttgcgactcatgctctggaacacacggttattctttaaccgggatacatactcatcattttgatactggaaaccttggccagagtgaattgtcattcgataattcactctggcctattttgtagtagttcgtctaatggcttagtaacgaactctaccgtttgatgtaaatcaatattccaggtaagccaccttgatgcgaagcagttcattctcttcttctggcttgttcatggttcgattccaccttcgtttatcaggttttagacgaccagactccaacgcgcgttcccactgccaaatcaacgaagggctagtcaccctgaactttctcgctgccacgggataagacgcgtgatgtgtaagtcgccaattaattaccttgattttaaaggaatatgggtagaagtcataaaagaatgtagacacatggaaaagattaaagaacattataagttatacaagtctggtaagtttttacttactgcaggtttaatgactgtcactgcaacggtatcggtcatgggtaatgtacatgccgatgaggcacaagctgtcacacctgatacatctttggagcaagcaggattgctggctgaggcaggagaaggtcaacttgttttgacgccagccggtcaagatgcagccccggtatcagaggacacatcacctgatgatagtgagagaactacaccaacagttgccaataattataagccagcaattgattcagttgacacttcacaacctgcaactgcagcgccaaaagcagacactgatgtatcaacgctacaagtagattcaactacgaagacagattcagacataaaagaagatacaccaacagatacaacaccggttgtaccagtagcgcaagccgaatctgatactccgcaattgacatctggtggtacaaacgacacaaagactgtgcaattaaccactgttgaaggaacgtccaagcaagtggtaacgacgccgaaggaagagagctcaactgacaaatcttcgtctgtggtttctaaacagacagacaaaacgtctttgccaaccgtagcaacagcaacagcgacgacagtgtctaagattccttcagtgacaggtgattaccagtttgacgaaaagacgaagacttatacgttcacaggtaaagatggtcagcccgtaactgggttggtttacgcgaataatatcctgcaatactttgatgaaacgggtcatcaagtaaaaggtcaatacgttacaattgcaggtcatgtatattatttcgacccagccagcggcgctgcacaaacaggtgttaatcaaatcgatggtaagatggttgggtttaaatctgatgggtcacaaattacgtcaggtttttctaatgataacgccggaaattcttactactttgatgagtctggaaccatggtgacaggcttgcaaactattgctggtaagacgtattactttgacaaagacgggcatctccgtaaggggtattccactattattgataatcaattgtactatttcgatttgaaaacaggagagtctgtttcaacaacgacgtccaatttcaaatctggcttgacatcacaaacggatgacacaacaccacataatagtgcggttaatatgtctaaggatagttttaccaccgttgatggattcttgacagctgagtcatggtatgtacctaaagatattcaaacatctgcgacggactggcgtgcatcaacgcctgaagatttccgtccgatcatgatgacttggtggccaacgaagcaaattcaagcagcgtatttgaaccatagaaccaaaaaattatgtaccattcattcccgcttataacccaggtggtaccacaatgggcggttttcaaggtgtttgggctggtgtagccggtattttcttggcatatatcggatttgattcaattgcttcaaattcagcagaggcgattgagccacaaaaaaccatgccacgaggaattcttggctctttggcaattggtgtcgttatgtttgcaggtgtctcattagtcttagttggaatgtttaagtattcacgttatgtaaacaatgcagcacccgttggttgggcattgcgtgagtctggacatcctttgattgcagctattgtctcaacggtcgcagtggtcggaatgtttaccgctttaattggtatgatgatggccggttcgcgattgctatactcatttggtcgtgacggcatgttgccattatggttaggtcgtgttaacgagaagggcttgcctaattcagggctgattgtcttgactgttgtcagtgttttggttggttcactttttccattttcatttttggccgaattaatttcagcggggacgttgattgccttcatgtttgtgtctgtggcgatgtacgccctgcgccctcgcgaaggtaaggacttaccaacaactggattcaaaatgcccggctatcctgtaacaccagcaatcggattcttgctagcgttctgggttttctggggcttaagcattgatgcaaagatttacgcattggtttggtttttgcttggcttgattttgtactttgtatacggtgcaaaacattcagatacacgacgtaaacaggcccgaaagtaaagaagcgttggcggtatttttagagattaaaatgtttttctgtttaaagagaggcgtgaaagaatatgactagaaatgatgaaatcttggatggagaagaaaagtatttcgcaggtgcggaccgtgtttattattttgacatggtgattgattcaggaacaggcgccgtagtacgcgatgtcgcaggaaacgaatatattgatctattagctagtgcaagtgctacaaacactggccatgcgcatccagcaattgtgaaggcaattactgagcaagctcaaaagttggttcattatacgcctgcgtatttttctacgtcgactgaggcaaaattggttagccgactagcccatctagttcctgaagaaggcgattggatggtggcctttggaaattctggatcggacgcaaatgacgctgtaatcaaatttgcgcgtgggtatactggatttgattgctacctagtgtgatccgaaaacactgcattgttcgttcggtaaatgttgaatccgtcaaaaataccgaaggtggacaataaacaaacattaacagttaattttgagcgtaaattaagccattctgagagagagagaattttattaactataccttgtaaaaggtagcttaactcacgaactacaaaatcaattttacacagtagtcatagtaacttgataaaacaaagcagtcaacaaataatttgaattccattgacaatacccttaggtcatcaatcatatagacgcgctacccatgtacagctcttactagaacaattgtagtatttataaaccagcctctttaagttttcgcttcaccttgtacttctgcttccgtatggctgttggtcttctgtcaaaagtggtgtgtagatcatcaaacgtcattctatctccatacttagctttaaatacattctgatagaaaggcgtaagcgtatcatgcaccacatcatcaacaatctttcgtacccgtttcatatcgtcatactcagctctgtgcgcttctaaaaaacaacccctgacacctcatagattgctacatgcttgtcaagtgtaccgttgaaatagtcagttaataacttatcgtatctttcagccattattcaactctgcagcgtcactgtgaaatcatacgtatcacgaaaagcgatagcaaactctatcaacccctcttgcattatttcctgtgatcgcctagacgaaagatgagtatcacaactaatagctccgtgagtttcttttaaaatgtatttacgccatatcaacacacgctttagcatgtctaaactcataagggcttctattaagctgtttgcatatccaaccacatcataagttgatgatttccccgtcatcggaaccctgttaagctgttcggggtctgcctgataaacatcaaactgggaaatgaacaaaattctaattgcctccgactttaaaaagtccctaacctcttttgctgttgctgcgttatctaccgtttcaatcaattttgccatatactcacctcatcttttcacgcatgcaaattacatctatttattgtacaacgtgttcaacgcttataactcccccctcatacgaaaaattggctcgctatggaaaacgagactactgcatcggtactccttgactgtacccatggcccccctttattcatatcgtggagttttattaggttgttcaaaaaatggtggtaagacagcgatggctgttgagaataacttaaataagtggctgaatgctggcgctactaatgcaacggctgttggtgaatatgaaagtgaagctcaacagattcagcaaacactgtacagaaaccagccgattcaacgtgaaaccggaccaagtaaaccgactgctgaacagattgatcaacaaaatcaacgcatggctaaagagcttggctatgcatcagttgaagatatggctaaggggacagcagagaagctgtcagaacttagaagaacacgagctgaccgattagccgctaatgcgtcaaacgggcgcacagcgaacggcagacgtgttgtacagcgtttctagaatattgggtgtgtcagaaatgacgggttagtggtgggtattaaggagcaagtatgggaattaagcgtattgagctgtatgagttcagtgagcatgcagcagagcaattgaagaaccgcttcaaaacggagcgaaataattggaagaactggctgacgtcattcaacatggatgcagaaatggtcaagatgcaaaataacggcacacaagtatggcatagcggtgaagttggtatggtcatcaatcctcacagcaaggtcattgtgaccgtttatcacatcttctcgaatgatttcccagatgaactcaaaaccgaccttgcaaaggcggcacaacgtctaaaaatggatcacatcagtgcgttttcgcatgacatctaccgcgatagtgcaaaatttgcatacctatcctatgacactagcgaagaagatgcagacaacttctacaaaatgacggttgaacgtattcgagacttggagcataaggcagatgagtcaattaaatatatcgagggattgaatcaactgattgctctcaagaacgacgtagcagaagaagtcgactaaacgtgaacagccaagggtgaaaagactgagagcccgtatggaggaaataagatgattatcgttaagtggcaagaagtgatcaatggcaagaagaaggatattcaccaacacgttgtgaacatgcaactagccaatcaactgcgtaacagta
